United States Patent 11,180,807 (METHODS FOR DETECTING A GENETIC VARIATION IN ATTRACTIN-LIKE 1 (ATRNL1) GENE IN SUBJECT WITH PARKINSON'S DISEASE) - sequence listing, part 29

SEQ ID NO: 383 - DNA, 855374 bp, Homo sapiens
cagttggcgcgggccgcgggcgaggcggggccgcgcgcggggtcccctcctcctcccggtcaggtcccctcaggagcgccgggcgcagtctgcgcctcccgctccccgcctccggccgggtccgggacgccgcggctgtggggtcggcccgctaaggacaaggtcgggagactgggtggcgatgcccgagtgcgactggaggcagccgagcggaggcgacggcggttgggatctgtccctcctgaccggggagcgggactcggacgggcgccggtgaggaggaggagaagcggcggcggagaggttttctgcggccggaattcccttcaacagcatccctgtcggcgcccgcgagcgcagtctcgccgggcaggggcgccggggaagatggagactgggggccgggcccgcactggtaccccgcagccagcggccccgggggtgtggagggctcggccggcgggcggcggcggcgggggcgcctcctcctggctgctggacgggaacagctggctgctgtgctatggcttcctctacctggcgctctacgcgcaggtgtcccagtccaagccgtgcgagaggaccggctcctgcttctcgggccgctgtgtcaactccacctgcctctgcgacccgggctgggtgggggaccagtgccagcactgccagggcaggttcaagtaagtgccttcgccggaccccgaacctccagccctgcctcgctcccgtcgcggccttccccgcccccctcgcggcctcccccgcccccgtcgctgcctctgatcccccggccgtgagtgaacctcagcgcgcggcgggagcgggcgagagtggggcccgcgccgcgccccctccagccccggggcgccccgggagagctcgggcccgcgcggagccctgaccaacggggagctaggcatttctcgagcgttccagatgtccgcagcgacttctgatccgctgctcagcacgaacattttcacaatcagttatgatgcccagcaccattttcttgggataatatttaaaaatcagaaattgtccaagttacttatgaaatacatgcgcattgtgaaaaattcacaaaagtgtaaaggttcagttatgatctatgagtgcctctctctttccccatcctcttctctctagaggtgaccccttctaacatttatttagtcatcatagtgatgttaataagtagagtttatgatggacttgctaagtgccaaacactcttctaagcgctttatgtcaattttctcatttattccctacaacaactctgtgagttgctagaattattatgctggatttacggagagaaatcgaggcgatacattgaagtaacttggccaggattacacagtagtaagggccgagttatgattccaaatcagctggcacattctggagccagtacacactccagaatgtgtacttttaacgaatttgctgtgttgtatttgctaggacaatcttgaattgagaaatacaaaggtgactttaggttagatagaaggacgtttttatgtggtgaggataatggatttttttctgatcggttaattcactgtcagcttttgtgcgggaacatcgctttggcttgtttgaagctcaaggagcctaagaagtttgcttgctaaggtgaaggtactttcttcgtactggttggtgtttattacattcttgcctgatataaaaagcaatgggtcacagtgtaggggagtagcaaaagtcacttaatattggggcaggcttctaacaacatgcaggtaacagtcattaagaaagtcagcttcttagtcttctagatacttaatatgaagtttgctggctggtttgtggctcttgaatattgtagattactgatattgttaggctgatagccaaaatctaggtgaaatttctcttgggctctaaggcaaaggtaagactggttcaccttattaatgtattctaggacaatttcctggaattttaaacacagcatactttcctttttttttttttaaaaaaaaacttactattactgattaaaataaatgtcccttaaaactcaatgtaaaaatgtatatttttaaaatggcactttaaaattttaggtagagtctatgatttaaattaactagtaggttttggaagtgaaatcttaaagtgaagttttatgaaacttatgcaataggttgaaatttttctagggtttatactttaaaggtagtatagtaatgtagttttaaaaatactttttaaaaaaattaggagagatgctgattaaaagtttaaaaagtgtttcaagatgaggaaagagatcttaatgaattctgcttgttagttgtttttttttgcttgtgttcttaaacgtttgctatgacagtagaattcagcgtctttacctagcaagagagaattttgaacatgtaaactggtagtcagcagtgaaaaagcctcatccattttttacattttttttacataaatagggagagtgcctgatttatatgtagggatattggcttttgtgtgggtgggtttgctccgtttgtctaaagaggacaaaatttgctgcagtcctgagaagcttcattttaaagtagcggaacttgttaatcagctggatcagcagcctgtgacctcactagcagatgttgtcccagttaaaaagatcacagatcaagttaaaactagcttaaataacattgagaggtggtgttcataaacaaaatacattagtgagtagaagaagaatagatatttgatgtagatattgttaaataacaataaatcctgagctaatcactgagtattcatcttttccttggaagctattatttcctaggactcattgtactctattgggtaaatgcttttgcatttctctgtggaatacaagctattaattagagtaaatataactggtgtaacgatctgtgtttttattatgtatactcttggggataaagaacacattggtatttaatgttaaagagaaggattatgtatagtagaaaagaattcttcttggtaaagtacatgcaaataaacctatgaaaggtttatttgaagatagtagcttgttttacctggcatttgaagtaataacacagtgggaaaggctttaactagaaaatctcacttcactaactatcttgaaaatctttttctaaactgaaggatagcaaccttacaaacagacattaaaaatgattgatcaatcttggtaagcaggtgtcaaaattaattggttggctccatggtaacttagctttttttctactatagggatttcgccagggaataaaaatgttcttcaaatgtttcttgaggatagaagattgatagttgggggaagaaatgcagaagcaaatatagtatcaaaagtggtacttcagttctcttagcattgattccagtcttctgttttcatttgaaaagaataaagcactcagaataacaagccattccttccttacacaggtaaaacaaaaggaacattgatttttcacccaaagctagactaaaggacttgggattgagaataggaaaatatatttgaaatataataatcaaagatacagactctaattcaagttgtatttatttgaatagttcagtgtaatgttaagcaagaaaatattctgctataatctatttgaatgacgttctcttttagaagggagcccttgagaattaattttgtagagtagagatttatataaatttatataaatataaagagtattgctctttatattagtcaaatataaaggggtatatttttacccctcttaggttagtcaaatttggatacttcatttcacgcatttaaaatggaagtatgctgggtgccgtggctcaggcctgtaatcccagcactttgggaggccgaggtggaaggatcccttgagcccagaagtttgagaccagtctgggcaagatagtgagacctcatctctacaaaaaatattttaaaagtagctgggcatggtggcacacacctgtggtcacagctacaagagagagtgaggcggaagaattccttgagctcaggaggttgaggctgcagtgagctgtaatcacgccactgcgctccagcttgggtatcagagcgagactcttcttaaaaatttatatatacatatatgaagcattctatttgtagtgacagcaaaatgaagatgtaatgatataatgtcaggaattaggttgttattatagacaaaaacgggcagaataaagtgtgtaaactcttcccctaagctgttaaaaatatatgcatattgcctggcttggtgtctcacgcctgtaatcccaactctttgggagaccgaggcgggcggatcatgaggtcaggagatcgagaccatcctagctaacacagtgaaaccccgtctctactaaaaatacaaaaattagctgggtgtgatggcacgcacctgtagtcccagttactcaggaggctgaggcaggagaatcacttgaacccaggaggcggaggttgcagtgagcataggtcgcgcaactgcactccagcctgggcaacagagcgagactccgtctcaaaacaaaacaaaaataaacaacaacaacaaaaaacaaatatatatatatgcatatgtaaatacatatatatttggaatcctttttacttgtaaggaaactgacagtaattataaacttaaactgaatgttccctgtccctaagacttctttatttcaaagttttattttaatggataatttatatccatggattatttttacattattaaagtgtataatcacacagtaggaatttaaaataatttaaattgagtgtttcttagattctaaattgataaggtaagttacttgtagaagcatagtagcatggttttcaagaacacgtgtctgcatgatttggcccctttagctgattagactcaggcctcctttcctctgccctgactggccttttgaagttccttgaaagtgtcacattccttttggccttagtgcattttatacacgtaactgtgaactctttcctctctggtctttgcttgggtgattactgatcatccttctaatcttagcttaaatactagtttcttttttttttttttttttttttttttttgagaccgagtctggctctgtcacccaggctggagtgcagtggcgcaatctcggctcactgcaagctccgcttcctgggttcacgccattctcctgcctcagcctcccgagtagctgggactacaggcgcccgccactacgcccggctaattttttgtttagtagagacggggtatcaccgtgttagccaggatggtctcgatctcctgacctcgtgatccacccgcctcggcctcctaaagtgctgggattacaggcgtgagccactgcgcctggccacttaaatactagtttctaaaggaggcttgtctgactcttcacactaggttaccccttatatactgccctaatagcactatttttccttcttagtattgtcaaaaatgaggtgtttaattataattttgatagttatttaaacaaaatttttaagagattgaggtataattgtcaaacagcacaatttaaaatgtacaatttatttaaattatacaatttgataagttttgtcatatgtatttgcatctgaaactgtcaccacaatcaaaatcatgaaaataccaatcacgctagaaagtttccatgtgtttcctttgtaaaccctcccttttctagttgccaattcctgtcccagggcaactattgatctgctttctctcactatagatttgttggtattttctagaactttttgtaaatagaatcatacattatatacttcttttttgtctggcttctttcacacagcgtgtttattttgagattcattcatggtgtgttagtagtttattctactgccgaatagtgttccagtgtctggatacaccataatttgtttatccattcaactgctgatggacatttggattgtttcaaatttttggctgttccttataaagctgctacgaagtttcatgtggaaggctttttatctttgtatggtcatatgctttcctttctcttggggaaataacctgagaatggctggatcatatgggtagatatatgtgtaactgttaaagaaaccgacaaactgttttccaaagtagttgtatcatttatgttcccaccagcagtgagtcagtgttctatctagttaatttcacatccataccaatacttggtatggttagtcttttaaatttttgtgattctaataagtgaatggtatattattgggttttagtttgcatttcccgaattactaatgatattgagtatcttctcatgtgcttacttgccatccgtatatcttctgtaataggcatttattcaaaccttttgcatgttaaaaaaattttcttactgatttttgtgagttctttacattttctggattactagcttcttatgaggtatatcatttgcatatattttctaccagtctgcggcttgtctatgaaaacaatgcaaagagaatgaaatctcttgacagtatttttcaaagaatctaagttttaaattgattaattccagtttatcatttttttcttttatacttttcatgttgtgcctaagaaaagtttgcctaggctgggtactgtggctcatgtgtgtaatcccagcgctttgggagcctgagacaggaggatcacttgagtctaggaatttgagtgcagcctgggaaacaaggcaagacactgcctatacaaaaacatttgaaaaattagctggtcgtggcggtgtgcgcatttagcccatctacttggaaggctgagatgggaggatcactttaacacaggaattggaggctgcagtgagctgagctgtgattgtgtcactgtactccatcctgggcaacacagcaagaccatgtctttaaaaaataaaaaataaaaaaaaaaagaaaactgcctaaaccaagttgatgaagattttcttcattttttttctctagaagttttgtaattttagattttacatttatatttatggtccattttaagttaatttctatatatggggagaggtatggatctaaattcagttttttggcatataggtatttgttttagcactatttgttgagaagagtattctttctctgttaaagtagctttgcacctttgttgaaaccattcatatatttgtgtttctatttctggactctgctttgtttcttgatctctttgtctatttgtatgtcagtacaacaatgtcttgattattgtttctttgtaagtcttgaattctgggagtgtttttcagttttgttcttttccaattattttggctactctgagtcctttgtatttccatatgaattttagaatcagcttgtcagtttctataaaaagcctactaggattttgtttgtaattatgttgagtctatagatcaattttggggaaaatgaataccttgtcagttttgagtttcctacatggtatatctgtttatttatttagttgtttaatctgtcagcagtgtttttaaatttctagtcaatagatcttgcacctcttttgtcagatttttccctaagtagttaatatttttggatgctattgtaaatggcattttttaaactttcacttttgattgttgctattatactgaaacacaactgatttgtgtatgtttgattttttatcttgcaatcttgccaaacttacttattacttgtggtagatttttgcagattccttatggctttctacttagatgattatattgtttacagacaaagatatatttacttctttctttacaatctagatgcctttttttttcttgccttatttcactggccagaacctctattacagtaatgaatagaggtgatgagagtggtcaatcttacttaagatttagggggagatatttgatctttaaccatgaagtatgatgttatctgtaagttttttttttagatgccttttatcacactgagaaagttcccttctattcctagtttgccaagagtttttaccagtgatggaaactggattgtattaaatgcattttctgtgcccattgagataatcatatgattttttcaagtttgttaacatggtgaattatgtacataatttttgaatgttaaaccaaccttacattcctaagataaacttcctctgacacaatatgctttcctttttattttaggttggatttggtttgttaaagttttatttagaatttttgtatctgtgttcatgagagatattagtctgcacttttcttataatatatgactagttttggtgacaagataatgctggcctcatataatgagcaccatgggactctcctgatcatttgctgaaagagtttttagggaattggcattatttcttcattagtgtttggtggaattcaccatcgacaccctctaggcctgaagttttctttaactccaaattcaacttttattaatatacattcaacttatttaatatacagaaggctatatgactagaatcctttaaaatttattggccagaatattgtctatcttggttaagtatttttttgggcgtgtgaaaataatgtgtattcttctattgatgggtggagtgttgtatacatttcagttaggtcaacttggttgatagtcttgttcaagtcttctacaaccattctgattttctgtctgtttttaccacttattgagagaagggtatcttcagttataattttgtatttacctgtttgtccctgcagtcttatctgtttatccttcatgtattttgaaactatgttattaggtgcataaaattttggattatgtcctcctgataaactgagcctttatcgttatccaatgaccatttgttgaaaagactatccttttttcattaatgtctttgtacctttattgaaagttaattggacgtctttatgtatatttattttttgactcttttctgttccattgatccatatctctatccttttgcaaattcctcactttattaatgtatgtatgtactttattaatgtatgtatatgtgtatatatatatatacatacatatatttgagatggagtctcactctgttgcccaggctggagtgcagtggcatggtatcagctcactgaaatctctgctcgtcaggttcaagcggttctcctgcctcagcctcttgagcagctgggattacaagcatgtgccacctcacctggctaatttttgtatttttggtagagatgaggttttgccatgttggccaggctggtggtctctaactcctgacctcaggtgatccacccacctcggcctcccaaaatgctaggattagtatatttttacagtaaatcttgaagttagataatgagattcccccaactttatttttatttttgaaaatttacttggttcattttgtttttcatatacattttagaactgtttgtcaattaaaaaagtcttgctgggatttttattgagattgtgttgacttagtaaatcattttgaggagaattgatatgtaaataatattgaattatctcgttcttcattgcagtatgtttttttcatctatttgggttttcattgattttttacaacagttttttgtagttatcagatacagattctgtgtatatatttttagtgttttttttttttttttgagatggagtcatgctctgtcactcaggctggagtgcaatggcatgatctcggctcaatgcaacccctgcttcctgggttcacgcgattctcgtgcctcagcctcctgagtagctgggattacgggcgcccatcatcacgcctggctgattttttgtattttttgtagagatggggtttcgccatgttggctaggctggtctcgaacttctgacctcaggcaatccgcctgcctcagcctcccaaagtgctgggattacagatgtgagccactgcgcctggtcatattttttgattttataccaaaatattttatgttctttaaggctattgtagttggtagtatttcttttaatttcaatttccagtttgtagactttaaaaaaataatcagggaaatctttctttggtgatatttcctcgcccatatctctttattttttatttttgtggttacgttataggtgtatatatttatgggataaatgagatattttgatacaggtatacaatgcctaataaccacatcagggtaaatagggtattcattacctcaagcatttatcctttctttgtgttataaacaattcatactaattatactttctacccattaaccatccccatttcccccactccaatacctttcccagcctcaggtaaccatcattctactctatctccatgaattcaactattttaatttttagctcccagaaataactgagaaaatgcaatgtttgtctttctgtgcctggcttatttcatgtaatgtaatgatgtccagttccatccatgttgttgtgaatgacaggatatcattcttttttatggctgaatagtactcccttgtgtatatgtaccacagtttatttatccattcatttcttgatggacattttggttgcttccaaattttggctgttgtgaatagagctgcagaaaacattgaagtacagctgtctcttcaatatactgatttcctttcttttaggtaaatacctagcagtgggattgctgaatcatatggtagctctatttttaattttttgaggaacctgcaaactgttctgcatagtagttacactaatttaccttcccaccaacaatgtaagagggttcccttttctctatatccttgccagcatttgtttctgtctgccttttggatatgagctatttaactggagtgagataatatcacattgtagttttgattttcatttctctgatgatcagtgatgttgagcatctttttatttaccttttgacattggtatgtcttcttttgagaaatgtctattcagatcttttgcatatttttgaattggattattagattttttttcttacagcattgtttgagcttattatataatctggttattaatcccttgtcagaatgatagtttgcaaatattttcttccattctgtggatcgtctcttcatgttgttgattgtttcctttgctgtgcagaaactttttaactcgatatgatcccatttatccatttttgctttggttgcctgtacttgtggggtattactcaagaaatctttgcctagtctccaggtgtcctggagagttttcccaatgttgtagtagtttcatagtttgaggtcttagatttctaagtctttaatccattttcatttgattgttgtatatggtgagagataggggtccagcttcattattcttcatatggatatccagtattcccagcacaatttattgaggagactgttacttccccagtgtatgtgcttgacacctttgtcaaaaatgagttcactgtaagtatggatttattctgggttccctattctgtaattgctctatgtgtcctttttttttctcttttttttaatgccagtaccatgctgctttggttactatagctctgtggtataatttaaagtcaggtaatatgatgcttccagtattgctctttttgcttagaatggctttggctattctgggtctttttggctctgcatacattttatgattttttttctatttttgtgaaaaatgtcattggcattttgatagggattgccttgaatctgtagattgttttggatagtatggacattttaacaatattgattcttccaatccatgagcatgaaatatctttccattttttttggtgtcttcttcaatttctttcatttttcccctgcctagaggtttgtggaactttgaacttcagcgagatgatttaaggtatctggcagaagaaatttctaagcagcaaagcattcaagatgtgacttgggtgctgttaaaggcattccattctcaaagggaaacagagcataaaaatttgggaaatgtacagcctgacaatgatagaaaagaaaatcccattttctgaggagaaatttaagccagctgcagaaatttgcatgagtaacgagaagccaaatgttaatttccaagacaatggggaaaatgtccccaggccacgtcagagatcttcggggcagcccctctcatcacaggcctggaggcataggaggaaaaaatggttttgtgggccaggcccagggttcctgtgctgtatgcagcctagggacttggtgtcccttgtcccagctgctctagctatgactaaaaggggccaaggtgcagctcaggctgtggcttcagagggtgcaagctccaagccttggcagcttccatgtggtgttgagcctgcgggtgcacaggagtcaagaatcgaggtttgggaacctctgtctgcatttcagaagatttatggaaacgcctggatgtccaggcagaagtttgctgcaggggtgggactctcatggagaacctttgtatgtcagtgtggaagggaaaagtggggttggagcccccacacagagtccctactggaacattgcctagtggagctgtgagaagagggccactgtcctgcagaccccagaacagtagatgctcctacaccttgcaccatgtgcctggaaaagccgcagatgttcaacgacagcccatgaaagcagccaggatgaggctgtactctgcaaagccacagggtcggagctgcccaagaccatgggaacccacctcttgcatcagcatgacctagatgtgagacctggagtcaaaggagatcattttggagctttaaaatttgactaccctgttggatttcggacttgcataggccctgtaacccctttgttttggccaatttctcccatttggaatggctgtatttatccaatacctatacccccattgtatctaggaagtaactagcttgcttttgattttacaggctcataaatggaaaaaacttgccttgtctcagatgagaccttgggggtgctgaaatgagttaagactttgggggactgttgggaaagcatcatttgttttgaaatgtgaggacatgagatttggaggggccaggggcagaatgatatggtttggctgtgttcccattcaagcctcagtttgaattgtatctcctagaattttttgatgtgttatgtaaaggaattacccagcgggaggtaattgaatcatgggggccagtctttcccgtgctattctcgtgatagtgagtaagtctcaacaatatctgctgggtttatcaggtgtttctgcttttgcttcttcctcatttttctcttgccactgccatgtaagaagtgcctttcacctcccaccatgattctgaggcctccccagccatgtggaactgtaagtctggttaaatctccttttcttcccagttttgggtgtgtctttatcagcagtgtgaaaatggactaatacacttggtaatttataatgaatagagatatattggctcatgattctggaggctgggaagtctaagatcaagaggctgacatcttgtaagggctttcttgctgcatcatcctgtggcagagggtaaatagagggtcaagggataggcaaaagcattcaaatctcatccttttataaggaacccattcccctgataatgaactcactcctgaggtaacagcgttaatgccctcatggtttaatcacctcccattatgccccacctctcaacactaatccagagccttcactcagtccagcaccaactcaaaagtccaaagtctagggtctcttctaaatcagatgtaggtgagactcaaggcacaattcatcctggggcaaattcccttccagctgtgagcctgtgaaatcaaaacaagttgtttacttccaaagtgcaatggtgagacaggtataggatctacattcccgttccaaaagaaaaaaaggggtaacaggccccaaataagtccagaacccaacagaacaaacaatgttaaatctgaaagctagagaataatcttttttgactttatgtttcgccttctgagcatacttggatgaggattgggctcccaagacctcaggcagcccagcccttaggctttgctgggctgagcctacatagcagctctcatgggttggaggctcatgcctgccgctcttatagtctgaggctgcacatgggtgactctatagttctgaggtctcagaggcagccctgctcccatggccctattaggcattgctctagcaagtactttatgatgagtctgctgctgtagcatcctttcagatctacattgaggtagccgcatctccacaacttgtgcagtctgtgcacctgcagaattggcaccacatggatggataccaccaaggtttatttcctatacttttcagagctgcagccagagacacaccctggtttgcttgaacagtgactggggaggctaagggaagctgtgccagaatgcagggagcagatacttgaggcagcacagggcagtgaatgctgaggtcccatagatgcctttctggaaactgtgatctcaggatcctagatgggaggggcagcccaggagacctctgaaatgccttcaagatctctttctatcttgatgaatagcacgtgacttccttttatccatgctaatccccttatgcaagggttccttggccacacccttgcatgctttgcttttttgttctttacatatacaaactgtgacttttccaaatcattactttctgcttcccttttcataatatgttttgtttttaaatcattctaccttctcgcatctttactatatgcagttaaaagtagccacgcagctctttcaatattttgcttagaaatttcttccaccagatatcctagtgaagtggctacattgtctggggtatataccctggggttcatcatcatgcaccaggaaaatttagggcatggacacacacaaggggtttaggagtagaggtttaataggtagaagataagagaaggagaaacagcctcctttataaagggaggggtctctgatcggaaaggactggctggtggcaaatgtgccgagttttatagtccagtttgaggaggcagtgtctgatttctgtaggggtcacagattggttagatcaggtatgaagtttacatagtgcatggggaaggctggttgccccaccataatcttcttatgaaaatggatttcccagttgatcagcatcatcttgtctgctccttacaatacacatggctggcagagaagagaggatggagccaccattttgaaaatgtctagtccttagttcctgtcagcattcacccatgcaagctctcagcttgcaggctgctccttgttagaaaatgatttggggctgcttttcattgaaaaggaaagccttaccaagcactcccatgcccttgttctctgactaagtaattcctttctaactcccattatactagcttattgctcttaaattctgccttccatgaagcactcagatatgggcacaattcagccaagttatttgctgcttcatgtcaaggatggctattactccagtttgcagtatctctttcctcctttctgtctgagatctcctcagagttccctttactctccacatttctgccaatattctgatcataagcactaatgtaatctctacaaagttttaggctttccctgcagttctcttctgagccctcatcagaatcatccttaatgttcttttcataccaatacaagttttttctagccttttttttttcccaaactctcccagcctctacttattgctgagtttcaaagtggcttccctattttcagatatttgataaagcagtgttctatgcttcaataccagttttttgtgttattcagttttgtgctgctataacagaatacttgagacctagtgatttataatgaataaaaatttattggcttatgattctgttgggaaggccaagattgaggggccagaatttggcaagagctttcttgttgcatcattgcatgacagaagagcaaagagagggtgaagagagaaagagaggagggcaaaagggggtgaaatcatccttttataaggaactcattcctgcaataacagcattaatccattcatgagggctatgctctcatggcctaatcatctctcattaggttccacatccccacactgttgtatcggggattaagttttcaacacttttttggagggacacattcaaaccatagcagagactctgcttcatgtcaaggatggctgttattccagtttgcaatatctctttcctcctttctgtctgagatctcctcagaattgcctcacaattaaatattctgttttaggaggcaatcaacttgttttggttcagcacacatgacctagctcacttttcaaaaaacagagctttactgagttacaatttgcacctcaccatattcaccttttaaagatgtacagttcacttatgtttagcatatttagagagtggtacaaccatcaccattacctaattttaggctgaagagccaaattgtataaacaaattggtatctgtgacttgttaaaaaataatttctagggtatcttatatagtcagtataaaatcaaactaatctgtactttagatgtataaaaatgaatttttataatgatgttttatcataacatcattatatcagtattttaccatcctgagttatcaaagcatattataatttccaaaaatatagaaataaactgaggtaggcaaaactttaagatggcccttttgacttttatccctggtattactgtcatgattatgttatgtcatttgtcaagagggagattatttgggttttcttactctaatcacatgagccctttaaaagcagagtatttcccctgggtgctagcagaagaggaagctaaagactcaaagcataaactggatttgacatgctaatgcttgtttgaagatggagggagccatgcctgaaagtactagagaaagtggcctcttggtgctgagagcgagcaacccctggtcagcaactggcaagaaagttgggacctcattcatataactggaatgaactgaattctaccaacagtgaataagcctggaagtggatgcttttctggagcctctggataacagcctagctcaactaatacccatctgagtctatagggacttctgtcctatagaactgtgagataataaatggatgttcttttaaatttctatgtttatggtaatttgttaccagcagtaaaaacaaatttaggggcatatttagcaatacatcgttgaaaaaagttattctggctgaatttcaatgatactgagttaaccagaaaattaaattaattctttaaacatgatggtcaattgagttttattatctttaacagtaataatacaaggtgattgtcatttattaatttaagctttttataacaccttgtgtacctgtctttgatttctttggtctgccatgaatggttagaattaatgctcaaaatgtttgccataaggttactaattgctgtctggatccacgaaaggaagatgctctggcattttagatatctgatttatttgaccctatttgatgcacagtatacttccagtctaccatttgagccaaaaagtgaataggagaactattttacagatagcataaagttatgaaatgatcagtagatgtgatgaagtttagccaaaaggggaagagattgatcttatcattagatagtagattaatttgaaaataatgattaccatgtgcaagagaagtattccctgattaaaaaatgtttgagttgtatagttatctcagtagctgaagggaatgttgaggaaaaaatgtattaatgagctaaaatcttatttggaaatatccttgttagaattatagagctcagaatcagctgatgttgtagtccatttgtattgctacgaaggaatacttgacgctggataatgtgtaaggaaaagagatttgtttggctcatgattctgcaggatgtacaagaagcatggcaccagcatctgcttgtattgcggggctcaggctgcgtctactcatggcagaaggcaaatgggagctggtatctgcagatttcatatggcaggagaggaagcaaggggtgggagcggccaggccctttttcataaccaactctctcaggaactaatagagtgagaactcactctttactgtgaggatggccccaagccattcatgagggatctgcctccatgacccaaactcttctcagtaggcctcacctctgacattagggatcaaatttcagtgtaaggtttggaggagtcatatattcaaaccatagcagttgagaattaggcctcaaagtcagatagataatggttaaaatatcaactatatcaatactgaattggagaacatctttttcttgtgtggccataatgggctaatatttcacctcaaaattaaattacccactcatttatgggccaagttaggcaactgctgatctgtattgcaaggtaggacaacagtagtggaagatagtagtcagaatgcatttcctgtgcctaaaatagtctgacagtgaatgatctgataaagaagttaggaaaacagttccatttacaatagcatcaaaaaacaaaacaaaaaaaacccaaaaaaaaaacttacgataagtttaaccaaagaggtaaaagatctatatgtagaaaactagaaaacattaatgaaagaaattgaaggtgacacaagtaaatggaaagatactttgtgtattcatgaagtgaaagagtattgttaaaatgtctatattacccaaagtaatccacagattctatgcaatcctatcaaaatagaattagaaaaaaatcctataatttgtttgaaaccacaaaagaccacaaatagctaaagcactgttgagcaaaaagaacaaagctagaggcattacactagctgactggtctttgaaaagttaatggaaaatgcatattatgaaaaaactgcgtggatttcaaattttttttgcaccaaaacaaactcataccaaattgttataacaagtctgaatgggatcaagtttgaggcactaaggaggataagacattggtttgaaaagggcccctatcagagtaacataaattctgctaaaattgaagcaagagcaaacatcaaatttatggtgaagcttgggtggaagaaggtgaaattattgatgctttatgaaaagtttaggaggacaatgccccaaagtaatcagcagtttataaatgggtaactcattttaagaagggatgatatgatgttgaagatgaagcctgcagcaggagactattcacatcaatttgtgaggaaaaaatcatcttgttcattctctaattgaagaggactgatgtttgacagcagaagcaatagccaacaccatagacatctcaattaattcaacttactcaattctgaatgcaaattaaagttcagtaaactttccaatctatgggtgccaaaaccactcggaccagattaactagagataagagcagaggttttagtggaaattataaacaagtgggatcaagatcttgaagtatttcttggaagaattgtaacaggtgaagcatgactttaccactacaattctgaagacaaagcacaatcaaagcaatggctaccaggaggtagaaggggttcaatcaaagcaaaagtggactggtcaagagcgaaggtcatggcagcagttttttgggatgctaaaggcattttccttgttgactttctggatggccaaaatataacatctgcttattatgagagtgttttgagagttagccaaaactttagcagaaaaacacctgggaaagcttcaccagagagtccttcttcaccatgacaatgcttctgttcatttctttcatcaaacaagggcaattttgtgagagtttctatggaaaatcattaggcatccaccttatagtactgatttggctccttttgagttttgtttgtttgtttgtttcctaattgatatggtttggctgtgtccccacccaaatcttatcttgaattaccacgtgttgtgggagggatctggtgggagataattgaatcatggggccaagtctttcccatgctgttctcatgatagtgaataagtcttatgagatctgatggttttataaagaggaggtcccctgcacaagctctctctgcctgctgccatccatgtaagacatgacttgctcctccttgccttccaccatgattgtgcatgctccccagccacgtggaactgtaagtccattaaacctctttcttttgtaaattgcccagtctcaggtatgtctttatcagcagcatgaaaatggatgctaatacactaatcttaaaatgttttctaagggcacctatttttcttcagttgataatgtaaacaagactgcattgacatggttaaattcctaggaccttcagctctttagggatgtactaaatgactggtatcattgcttacaaaagcttcttgactttgatggaacttatgttgaaaaataaagtttatattttttatttttatctgtttttttttccatgaacttttagtcatctcatagttattaaaacagcgtgatacctgcataaaaacagacaaattgacccatggaacaggatagagagcccagaaataaattcacctgtctgctgtccactgattttcaacagaggctcgaggaatacacattggagaaaggacagtcttgtcaataagtgattctaaaaaactaggtatccagatatagaagaatgaaattaaacccttatctgatcccttatagaagaatcaactcaaaatggattaaagatttaaatggaagatctgaaactaaaacaactagaaggaaacataggagaaaagctatgactttggtctgagcaatgacttcttgcatgattccaaaagcacagacagcaaaagcaaaaatagacaaatggtattgaatcaagaagcttctatacatcaaaggaaataacagagtgaagagacaacctacacattgagagaaaatatttgcaaatcatacatcagataagggactcatacccaagacataaaatgaactcaaatcattcaataacaagaaaacaaataacccctatttaaacatgggcaaataatctgaatagacatttttcaaaagaaaacatacaaaaggtcaaaacatatatgaaaacatgctcaacattactaatcatcagggaaatgcagatgaaaaccacaatgggatgtcatctcatacctcttaaaatagctcttataaaaaagatgaaagataacgtgttggtgagtatatggcaaaaagggaagtttttgtacactattgggggaaagtaaattagtacagccattttgaaaaaaaatatggaggttcatcaaaaaactgaaaatagaatcaccatatgatccagcagtctgagtatatatccaaaggaattggaatcagtatgttggagagatgtttgcattcacatgttcattgcagcattgttcataatagccaatattgggaaacaacctaagtgcccaccaacggatcaatggattaaaaaaagaggtatatatacataatgaaatagtattcagcctataaagggacaaaatcctgtcatttgtgacaacatagatgaaactagaggccattaggttatgcaaaataagctaggcttagaaagacaaatatcacctgatctcacttacatgtggaatctaaaaatttgaatcaattgaagtagagagtagaatgggggttaccagaagctgtgggtggtggtcagttgggcagggaaaagaaaaatattggtcaaagggtgcaaagtttcaattaggaagaataagtgttctattatttcgttggcgttctattgtacaatgaagtgactaatgttactaattgtgcattgtgtatttcatatactacattgctaatagagtggattttaaatatttttgctgcaaaaaatatgtatgtggggtgatgggtatgttaattagcctgatctgctcagtctgcaatgtatacatgtattgaagcatcacattttaccccatgaatatatacaattattatttgtcaataaagatgaaatgaaaataaaaaggaattaataagctgataaatagtattttaactagaaaatctgtttttaaaaaagatttctatgtgaaaaaggcttacaaaggccaccctgcataaagactatccctgagtggatctgactattccttgtaggctggttatgccaggactaaacctatattctgtgataaacaggatttattgtttcagagatttcgtaaattaaaactatcacactttcttatttttataatgtgttaagttatatatccatagtcaaattatatatccatagtcaggatagacaacaacatcccactagatttaattttagtattgtctaatatttgtgctggttttcctgcatttattagtggccaaccttgtgttataaacagcccagcatgcttttaattaaggactctactttcagctagaatgagatattgacaaggcatatggatatgtggcaggcatctagacaagtgattggcaaactttttctggaaagggccagatagtagatattttaggctttgttggccagatggtctctgttgccagtactcaactctgtcctcgtagtgtgttagcaatcttagataatacttaaacaaactagtgtagttgtgttccaataaaagttcatttacacaaacaggctagtagtttatgtagtactgatctagatgaataagtcagtatggttctcagttcaagaagaggaatgatagaaagtttaaaaaaaagttgtttgaaacttggaatatgtattagaaataatattagaaatagtagttatgtaagagcctattttactttctttagggagttgaactatgtgctacctaatttctggagagcactacacaattggaatgtaagggtattaggagtaagaagtaaaaaaaaataaatggaaaactaggtgtttatggttagagtatggtcctggagtgcaagacttctgaattttagaagaacagttctagactgtaaagaggtccaaagtatgtaatgggaatgctttgcccaagtggcatgcaggtaaaggttcttggagtttaagaagagatcatgaaactgaagaaggagaattgttctttctttattatagaagtagcaggagatttctcccctttacgcatgtcttttggtggtgagaaggaattttccatttcttttaccttgattggtgacatcctcccatgcttccagtggactggtattggcaaggaggaaacctttttgtagtaagtggaggaaaaggtgggctcttggtaagatctttagtgctaaggataaggaattcagggattgtggtgagtagtttccttttaagtttgggaaattgtactactgaagttgaataggacgggacagggtgtgtagttttcaggtactcctattgtttagcttaggtagggaggcataacagttccttcacatcacttataagagggagataaggattactatggtagctcctacaatatatgtttctttggaggaagggggatatatatttttaatttttgtgggtacagagtaggtgtatatgtttatggggtatgtgggatattttgatacagtcatgcaatgcataatcacatcatggaagatagggtatttatctcaagcatgtatcctttgtgttacaaacaatccaattatactctcagttattttaaaatggacaattaaattattattgactatagtcaccctgttgtgctttcaaatactagtctcattcattcattcattctatttttttgtaccccttaaccatccctacctcctcctcactttaccactacccttcccagcctctggtaaccatcttcctactctctatctccatgggttcaattgttttgctttttagatcccacaaatcagtgagaacatataatgtttatctttctgtgcctggcttatttcacgaaacataatgacatccagttacatccgttttgttgcaaatgactgaatcacattatttttatggctgaatagtaattcattgtgtttatgtaccacatttctttatctgttcatctgttgatggacacgtaggttgcttccaaatcttggctattgtgaacagagctacaacaaacatgggagtgcagatatttcaatatattgatttcctttcttttgggtatatacccaacagtgggattgctgaatcgtatggtagctaaatttttacttttacgaggaacctccaaagtgttctccatagtggttgtactaatttacattcccacaaacagtataagagggttcccttttctccatatccttgccagcatttcttactacctgtcttttggatataagccattttaactggggtaagatgatatctcattttagttttgcttttcatttctgtgatgatcagtgatgttgagcaccttttcatgtacgtatttgaaatttgtatgtcttcttttgagaaatgtctgttcaaacctttagcccatttttaaaattggattgttggctttttttcctgttgagttgtttgagcactgtatatattctggttattaatcctttgtcagatggatagttcgtaaatattttctcccattctgtgggttgtctcttcatgttgctgtttcctttgctgtgcagaagttttttaacttgatgtgatcccatttgtccatttttgctttggttgtctgtgcttgtgggttattcctcaagaaatctttgcccagtccaatatcctggagagtttccccaatgttttcttgtagtagtttcatatgcttaactacctgttattatgctagacattttatttgaaaattattgatagaaataatttaaggcccaggataatgttatctttctttagagagtaccatgtatcttctgttaggagacttggcatattggcagttctggcagcaccataagccgattttaagacttgggagttttctgctgctcagatgactcatagctaacctacagttgaggtaaaggctggttaacttctggtacaccactattttaatagcaagtcattatgtcccaagtcaaagtgccctgttgtttctttgaacccctatgttttgtgggttattgcttccaacttttgtcctcctctccccttgaggctactaaatgcactctcaaccttttggcagtctcttctaaataagcaaatctctcagaacaaaagcatctctgaatgcctgcctcctcttaaagaatttgcaacttctggatcttggctttgtacattttatcattttgttacttgtaagattttaaaattgtcctttaactttttaagttgtcttcagtggagagtttttctgaattactgcacttagtattaatattattggaagtgaaaaatcagggcaagttatttaacttgttacttaaaatgtgcttcagacttctcatctgtaatatggagttattaattatttactatcttataggttttttgagatttttaaatgaggcaacacattgtgtttatagtggtacctgacatgtagaaaatgcttaagttattattacatttatttgagaatataggaatttgttgctcttcaaagattttccaagcatgaattagccactttattacaaaagtaatttgcagggattatgaaagatttgcaaatgacattaacattgactgacatttctgtcaaccctgatttaggtaaattaaagtttttcccccctaatgtatttaaggctctatactataaggaaaatttaattttatctaaaagtagataatggccctgatatgtatatgtgtgtgtgtgtatgtttatgtgaatatgtaaaaactgattagctgtgatgtgtgtgtgtttgcatatataagtatagtatataaatgttaaatgggaagacattttaattctttaaaatatggtctcttgataaaataattgggctggaagtaaaaaaaacaaaatgaagcagaattgagatttttgttttaaagatttttaatttctgaaaatagagtttttccaaatatctttttcttttttatgcataaaatagaagatacaattttttttatttgtcctgttttaaaaattgagttcttggactagatgtaaagtagacaggagaaaatgataataaaaaatatatttatagcagaactctttcaagtttggtgacacctattttagcaataccagtacatgaagaaaaaatatagcttacatgctaactccccaaagtggaacatacgtatactttttctctattccatagatttgtatttgatcttccttctgcctcaacctaatttttgtgcagatgaagtttaacttactctattttgcatcaacattgaatccttcagtactatgttcagtctttcagtgtcttttttcgcttcgtaaattgaaatggtcatgatatattaagatttaaagaaatccaaaataagtatcttttgagatgcagagaaaaatacagcactttgaaattttcctaagttgtaaataaatcctcctttttgaaaattgttatgtcccgttcctttggcttaatgacttttaaattttcttatcctgctatatgtcttaaagttattttaaggtaattattttcattattttattttctcttccaggttaacagaaccttctggatatttaacagatggcccaattaactataaatataaaactaaatgtacttggctcattgaaggctagtaagtatacagtctgagtcaaattaatgtattttattcttaaatgataaaggtgatcatattaatgtcagagcattagagtataattactttatcatttagtttgtttattattagataatatttacaacttctagacatcacatttaatgtaaattacactacctcttcacttgtgacagtagtttaatttttatatatattttgtttttgagttatgttattgtggtattaaattgagtaggcatttttttggtttattttgaacatcttgttatgaaatttgaagacttagaaattataaaagtatttcttgctgagctatgctattcatataatttagcattttagttcaaagggtatttttaaaagaacattttgtagaagagagagttaattattcatttagaggtattttcagtaagtagggcttgaaacaatctatctatttaaatgtattgtgaatggagcataaaagaattgatatgaattatttttgaactgttttgtaatttctaaagagtatatttggaaaattttgtatttaaatttttctaacttaaaagctgttcattctctgctgtgcacctgtagttacattttgtttatttgttaacattatatcacattgagaattttgattaaaatttaaatagttttttagtgcctccaacttaagggttctgtaaaaataagaatagtggcttcttgagtgttgatttttaaaaatcaactttatttaagtaccatttgtatacaacaaaatgcacccatttttaagtgtacagttccataaggtttcagtgatgtatacagtctatgtaacctctgccttcaatcaagagaaagattttttttttttgagacagagcctcattctgttacccaggctggagtgcggtggtgcgatctcggctcactgcagcctctgcctcctgagttcaagcaattctcctgcctcagcctcctgagtagctgggactagaggtgcatgccgccatgcgcagctaatttttgtattttcagtagaaatgggttttaccatgttggccaggatggtcttgatctcctgacctcgtgatctgcctgctttggcctcccaaagtgccgggattacaggcgagagccactgcacctggctgaacattttttattgactacatttttagaaaacaatgatacatacatatgtcctgttaatagattttgaaagttacattttatttgtacaaattagatatgatggcttatcaatctttcaccctgataaggatttatagcaaaattatctataaacagatttctaataaaataccctatctaaagtttcttcactctgtgctttgtatattatataataaatattatgtatttattcactctgtgctttgtatattttaatttgaaaaatatttcatattcattttcagtccaaatgcagtgttaagattaagattcaatcattttgctacagaatgtagctgggatcatatgtatgtttatgatggagattcaatatatgcacctttaatagctgtacttaggtgagtaattatatttaatcagttgcagaaaagtgactgtgtaattgcttctttaaatatatattgatatgtactgcaaaataaatttagtaaagatattgatagttacatttcacagatgattataatactttgttatgtgctgtaactgtcaatttaggtaataattatgtaaatattgatataacataaataagtactatattggaaatatagatttctttctaaatattttttattctcattgtatttagtttattctttcaaagtgccttgaatatgttttcagaactatctggatatattagcgtgagttctagctgacaaataaatagacaagttttgttttttaatagttgtttttttattttagtgaaatggtaaaattttaaattctgcataaaagggttaagttatgctttgtgcaatgattaataaagatggagtttctaccaattgtcaaaatgtgagagttttatttgtttcaaaatattttattgttagtcgtaaggtagattattaattttaaaattatagcattgtatcaatttaaaaatcttttcttgtgtatgtttagattattataaaaagtttcgtgaataggagaaaatctattagacacagaaaaaattatgaacatgtatagattttatatataatttaacatgattgttgataagttactcattatattatttacttttgctatttatacaatatctgttatatgttctgtcattgctggaaatttaagtatggataaaagcttattggtcccttcaaaatattttctttccaatttttctttttattattcatgtggcaaatattctatttcattctattctaatacattttattttgttctattttatcaggaatgtgaattattattttggacaaaaatgtaacgacttgtatttccttaggagcttaggtacttattctatgatattgctattgcttacatttttgagtcatttgaacattagaaaaaggatagccataagcagcccttcatctaaggacaatagagagaaaatagagtggagccttgcaaataattaggttgtaagataatttattgtaacaattaaatttgatcctcagttcatacatttatttttagcaatttaaacatcactttgctatctttactctatttttatgataccgttgactgaccatcatttagatgtgtgcctgttcatttgtttatctagtaattctaattactttgtattaatactcatccattagcattcttaccaacattttcttgttattaaaggaagataattagcaggtgagatttagtatatggctgtgaagatggaattagtgatttctcattagcaagtgttcttgttagccctcctaagggaaatggaaaactcatgtttattgatattgaatatccacttgatgttaagcactaggctaggcagtttaaatgtcatctaatcctcacaaagatctcgttgggggagtactaagtactattatccccattttacagttgagaaaattgacattcagagaagttatttgcttctaatagatggtagagctaggattaggacttgaatctcaatctcctgatttaaaagcatatgctgtttgtacttcatcttgctaagaattcagaatctaatatgtttgaattacttcaattgtataaatatttattactcaacatttaattacagagactgtgtcacaggcttagagtacatagtaaggaagaaggcataggctatcgcagtggctttagacaccaactacctgcagttgggctagaacagatttcctaggttaagagcacagtcctctacaacaagggtctcctctccaccccagatccccgtaccagtccatggcctgttagcaacagggctacacagtaggaagtgagtggcgggcaagtgagcaaagcttcatctttatttacagctgctccccactgcttgcattactgcctgagctccaccttctgtcagatcagcagcggcattagattgtcataggagtacagaccctactgtgaactgtgcatgtgagggatctaggttgctcattccttatgaggttctaatgcctgatggtctgtcactgtctcccatcagccccagatgggaccatctagttgcaggaaatcaagttcagggcttccactgattctacattatggcgggttgtataattatttgattacatattacaatgtaataataatagaaataaagtgcataataaatgtaatatgcttgaatcatcccaaaatcatcctcccccggtctgtggaaattttgtcttccatgaaactggtctctggttccaaaaaggttggggattgctgctctataacactgctgtcatttcagacactagctgcaagcttggtgctccccacctactctgaccatctggctacatatttaggggttcctactctgtcctaaaagtttgataattcactagaattatcatagaactcaggaaagttctacacttatgactatagttttatcatgaaggatagaaatcagagccagccaaataaagggatgcatagagtgaggtctgggaggatcataaatgcaaagcttctgggtcctcagaatgtgttacccacccagcacatcaacatgtatcaccaacagggaagctcatctgagcttcaggtgtccagagttttattgaagtttcattatgtagccatgagtgattgaatcattggccatgaggctgaactcaaatctccagcccctcccatccccttctctctcgggaagttaggctaataccatatggccccaacattttaatcacatggttagtgtttctggagtggccatcccctattctgaattatatctttagcttaaattaattaggggcccaccatgagtcacctcattggcataaattttcagggctcaccatgaataggaagacactcccatcactcaggaaatttcaagaatttagaggttatgtcccaagaactggggacaaaagccagccaaattctttagtatgcagtagtcatgcattagtgggggtatgtaaacagatttttcacacagcctagttagtgttacaatcaggttatgaaggagttctatataatttcaaaataaataactaatccttcatgttgactttcatcgtgagtaaaagtatgaagtatgggggtcagataggacattctagagagagaaaagcatatatacaaaggtatagacacattaaagagcattatattttagggcaatagttgaaagttttgagtaacttgattgtaggaactgtgaaggatacgtaggagtcacattaccccaaaacagcaatcagtgacatttacttagtgctcattttgtgccaatgtacaggagttctttatatgcattagtttatttaatcctcaaaataacctttaggtaggtattaatattgtaattttacaaatgcagaattgagacacagagattttctgtgagtggcccgaaggttgcctagctggtaagtcagaatatgaatcaaggttatgtaattataggtcctaatcccttaatcactgtaatattgcttgcttgtacaccacactaaagaagttgggcttttattctgtaggcaagagtttttagaatgtggagaatgcattggaatggagaagtgttatttttttttttttttactgtgtgctggacaattgtgtgttggacgttgttgtttggaaaatcatatatagtaataatttgaggcctagaaagattatattcttgcagagactacctggggacactcgcaatccatattcaactcaatccaaactcagatactgaggtgattcatagctcagctgcagtgcagtcctttggagggcctaactttaggtagtttgctttcacttccaaccattggagtcccagttcaacgtgaaggccttgtgtttcactttttctttccttcattctgtaaaatccctgaaattaccaccgagttttttttagcccttcaaatcttacctccagccttgaaatcagcaaatgccaatagggtaaatgacctcaatgcctgggcaggccttcaagctgatttttttgtttttatataatttgtcattttactagatttcagttggtccgaatttcctggtgtattatacagtaagtggaaactctcttttatttattgtttttaaaatacttgtaaacaaaaaaccaaacagatctattcttttttgtttgtttgtttttttgagacggagtctcgctctgtcaccaggctggagtgcagtggtgtgatctcggctcactgcaacctccacctcccaggttcaagcgattctcctgcctcagcctcccgagtagctgagactacaggcatgcaccaccgtgcccacctgatttttttgtatttttagtagaaatggggtttcactgtgttggccaggatgttcctgatctcttgacctcgttatccgcctgcctccaccttccaaagtactgggattacaggcatgagccactgcgcctggcccagacctattctttttatctttttcagagagcgctcagagactagctgtatctattataaagacctatttttagtaatactcacctttatataattttattacaatgaacaatatgtatgtataacttaagactggtgtcatagggtttgtattgttttgagagtctcattttaaaatcatttgttgcttcacaaacataacctagtagatgtaataataattactaaagcgttaaatcaagagttgattactttttaacttgtttgcatttgagaatgtattttctaaatcaattatttgactataatatttcatttatgtgtcaaatatgatttgaatgggggaattcagttcttagtggtacctaaacataattttaactgtttaaaggaattgaccgtgtcgagttatataatttgtttgttagcagcttcttttctttcaccaattgcatgttttcatagatttagagaggttagaacatataactaaatgaagataggtaattttcctcatgaacaagtatccttaaaaagaagtacaagttaccagtttaaaactattttgtacatttatatctcccccaccccaagtttttgtttgtgtgcttatgggcttatgtgagcaatattctgtcttggaatagttatatattaatgcaatttgcatagatatgcaaaattagaaaaacattaaagtctatatagttttaaattttttgaagtaaatattttaaatcacctagataaatgtattggaaatgtacagctataactagaatgtaattgtaattgcttaactgatgtagagtgtcttccagcttcatcggatttttaaaccaatcagaatgagtaaaggtacagggttttattagagtagcaaggtgactttaagtgaagttttatacgaattaagtggaagactaccctgtagtattatgacaggatggatagcaggacaaaaaggagaaatgagacattgccttacaaatagtgataagaaaaaaaatggggtacagtggcatgagagtagattttagtgtattggcagcagtagtagaactaatttagtgagaaatggatagggacttcttttagatgtattctccttttagttgcccattctgacgtacaagcattactgatcctggtaagaatatttctgagtaaattttatgtgcttaacagtcttatgtatatctatacatacaatattcagttttgttctcttttagtggtttgatagtccctgaaataaggggcaatgaaactgtgcctgaagttgttactacatctggctatgcactgttacatttttttagtgatgctgcgtataatctaactggtttcaacattttctattcgtaagtattttttaaaaattccttcttttaatgattcttgtaatttaatgtaaaagaggttttttttgtttatttttattaatgtcttgtataccagaagcaggctaccgtgttaaatttcaaattagtaggcaggatcccttcttaagtgacataaaatcttaataatatgccacaaaacgtgatctaaacctataagtttggttgaaaattaattatgaaattgacaattgttttttggcaagtgattaagtaaacaagtactagtgtagctttactggtagcaacagatgtggtgagactgcagggagttgtgaactgcctttcagtgctctaaggtatatcacttgtaatttgaagaggattatgggagctaagtttttgtagtccctattgcagagactgtactgaaagctatgcatacattatgtcatttaattaccttcaattctgtcaagtgggtatatttcccattgacacatgaggaaattgtggcttaagagttaagtggctataccactatctcctctaaaataagaaaagtaatattcattgagaatctattatatgcctgatactttatatacatttttatatctagaagactgagggtgaagtaatgagagatgctttcacaggaatggctagagaggaagtctatatattatttttttcttttcttcagaatgtagaaattggtaaccagagaatttttcaccagaaatattataaatatccttgaatcagcaatttattatggaatttatttatcctacaacgtatccaagtatgtatgcaagggagaacaaatatatagtagaatataatcacatggtggctcacgcctgtaatcccagcactttgggaggccgaggcgggcagatcacgaggtcaggagatcaagaccatcttggctaacacggtgaaaccctgtctctactaaaaatacaaaaaaattagccaggcatggtggcgggcgcctgtagtcccagctactcgggaggctgaggcaggagaatggtgtgaacctgggaggcggagctttcagtgagccgagatcgcaccactgcattccagcctgggcgacagagcgagactgtgtctcaaaaaaaaaaaaaaaagagtcttaaagctaaatatgataaacataccttttcttcaataacagtgtatgggtgatagcatgctcttttatattatacaaccaagttatatcttgacttctcatatagttttgaattttcatgaatttaatttttttctgtaaaatatacaatcaaaacattgagtacttaagtctttacaaaacattttgcctggaaccgtacagatcctgcagatgttgagcatgtagtcgttagacatttggagtcttggtatcaaagtaaatctgttgaataaaataagaccaactgcaaataaatactaacaatttcataagagtaagagggtacagagtaaagaattaaaactacattgtgaaattctgttacatttataagcacataggacacagtataaaaattataaagtttatgatgtatcaaccaaaattctttttcaattaccttgaatctgaatatatatgaattatattttacagaatcaattcttgtcctaacaattgctctggtcatgggaagtgtacaactagtgtctctgttccaagtcaagtatattgtgaatgtgataaatactggaagggtgaagcttgtgatattccttactgtaaagccaattgcggcagtccagatcacggttactgtgacctgactggagaaaaattatgtgtctgcaatgatagttggcaaggtaagcatgtgtggtgtgatggcttttgaaacattgattcatatatgtaatagattaatacaaattccacacgtttgtttcgttatagtttgcacacccaagccttatatatttacttttatttttagaatgttcagattaataatcaacttcttaataatttttttgtcacaaatagaattaattggcaaagattttgtctccatactactttgaagatcaaatgaagttatatatgaaactgaattgttaggtgtgtgataattatggtcttctgtaatttgttgttgaatctccccaaatttggtgacttcactgaatttaatgtggtgcattcaaatttgatttataagggtaatataaatagtatactacaaaaataaatgttcaaagggactgcagtatatgaaacttatttcttaggaaaggctgacatcttgtggctattttaaaaagaactagactatttttaaaagtattttagctgcctattgcagaagtcagatacctaggaaagaatttctaagtaatttttataaatatctatcatcaaagattaagtttagactacagtgaagaatgttggcttatttatctgtatataaaataataaatattgtcattatgaaattaagagatatgcttatacatatacctacccacctagagcttactttttgctagttacatttacctatgaagagcttcctttgtgccaacatattaatcctgttgaaatagggaaatttgactcaataattacataacctgaagtacttgattatgtattattataacacagtgtaataaatagtagcaatagttcccaagttaaaaaccaaagagaacatactcttcatgaagttgtattcattattcctgagatgaccttttcaaaaaagtgttgttgggtatgttgagtacttacttagaggaattattttaggctttgtgtaaattatgcctgtcttaagctcatgttagctcattaaaaaatattaggtatgtcaactgcacaaaagatctatgatttcttattaaatcgaatttggttaccaattgcaattatgtcagatgcaaatttctaaatgttttgtaattacagggacatgtattttaagtgactcttttaatcatttatgacttttcttccccccaaaagtgccttgagatgtaattttattttcatttctgtcgtgaaactaaaataactgtcttttctatagagacagtggtgtatccatattatatttgatttaaggcctgagaaatagaaatatagctcatatacacagtatttttcaaactggtcttcaattgctattagtctccacctcatttcagcagtcttaaaagcaaatgaggaatacatttgtataacattctctgtgaacaactctgccccttttctgttttttacttactttcattagtccttctttgaaatgctttattttgtgtaagtcttgtaatatagatctgattcaaagtattaagaatttttttctggcctttgttttttggccttttcatatcctattattctcatctgtaatgtcccaaatcataagaattcctgaatctaatatgtctataagcaaatggaaatgaggaagcaaatactgggtatgttcacttttaaagcaaagttatattatcagtagtctaagaactacttgtctgtgtgtgtgtatgtgtgtgtgtatgcatatatacacatatatttataactacatatatattttatatggagaatagtgtgaaagtgctttgtaaattataaaacgcagaaataagacaattttataccattttcttaataattaaggaaatgatttctgaattgatatgtttgaaggaggccttgtaaatgagataatatggtgttttcaagacaaattatgtgcagactggttactttgtgcctcaaactgatcctgattctgtatttaaggaagcatagctccaaagaaggtaggattgtgagcaaactcatttaggggaaaatgatgtttttatttcagatatatatagaatgggaaggaatcagtgaggtaagaagaggagatagatttgcttctaggacaaatggggaatgatcaaagaatgagagacatgtgaaaatgcggactgccgaggcaatctttatgaggttcaaaatctggtagttttatacaaggtgttatttggaactggattatttaggttagagtaacagattgttgttacctccattatattttatcctttgttgttgcttgactacttattctgtttggctgtatgcctaatgtatattttttaaaaatgagtgttaccctctagaaacttgggttttattaagataacacagaggaaaaacctagctttatattaagtcctttttttatttttatttttatttttttattatactttaagttctagggcacatgtgcacaacgtgcaggtttgttacatatgtatacatgtgccatgttggggtgctgcacccattaacacgtcacttacattaggtgtatctcctaattctatccctcccccctccccacaccccacaacaggccccagtgtgggatgttccccttcctgtgtccaagtgttctcattgttcaattcccacctataagtgagaacacgcggtgtttggtttttttgtccttgcgatagtttgctgagaatgatggtttccagcgtcatccatgtccctacaaaggacatgaactcatcattttttatggctgtatagtattccatggtgtatttgtgccacattttcttaatccagtctatcattgatggacatttgggttggttccaagtctttgctattgtgaatagtgccgcaataaacatatgtgtgcatgtgtctttatagcagcatgatttataatcctttgggtatatacccagtaatgggatggctgggtcaaatggtatttctagttctagatccttgaggaattgccacactgtcttccacaatggttgaactagtttacagtcccaccaacagtgtaaaagtgttcctatttctccacattctctccagcacctgttgtttcctgagtttttaatgatcgccattctaactggtgtgagatggtatctcattgtggttttgatttgcatttctctgatggccagtgatgatgagcattttttcatgtgtcttttggctgcataaatgtcttcttttgagaagtgtctgttcatatccctcacccactttttgatggggttgtttgattttttcctgtaaatttgttggagttctttgtagattctggatattagccctttgtcagatgagtagattgcaaaaattttctcccattctgtaggttgcgttttcactctgatggtagtttcttttgctgtgcagaagttctttagtttaattagatcccatttgccaattttggcttttgttgccattgcttttggtgttttagacatgaagtccttgcccatgcctatgtcctgaatggtattgcctaggttttcttctagggtttttatggttttcagtccaacatttaagtctttaatttatcttgaattattttttgtataagatgtaaggaagagatccagtttcagccttctacatatggctagccagttttcccagaaccatttattaaatagggaatcctttccccatttcttgtttttgtcaggtttgtcaaagatcaggtggttgtagatgtgtggtattatttctgagggctctgttctgttccattggtctatatctctgttttgataccagtaccatgctgttttggttactatagccttgtaatatagtttgaagtcgggtagcaaatggaaaacaaaaaaagcctgaggttgcaatcctagtctctgataaaacagactttaaaccaacaaacatcaaaagagataaagaaggccattacttaatggtaaagggatcaattgaacaagaagagctgactatcctaaatatatatgcacccaatacaggagcacccagattcataaagcaagtccttagaggcccacaaagagacttagactcccacacaataataatgggagactttaacaccccactgtcaatattagacagatcaatagacagaaggttaacagcgatatccaggaattgaactcagctctgcaccaagcggacctaatagacatctacagaactctccaccccaattcgacagaagatacattcttctcagcaccacattgcacttattccaaaattgaccacatagttggaagtaaagcactcctcagcaaatgtgaaagaacagaagttataacaagctgtctctcagaccacagtgcaatcaaactagaactcaggattaagaaactcactcaaaactgctcaactacatggaaactgaacaacttgctcctgaatgactactgggtacataacgaaatgaaggcagaaataaagatgttcttgaaaccaatgagaacaaagacacacaatctctgggacacattcaaagcattgtgtagagggaaatttatagcactaaatgcccacaacagaaagcaggaaagatctaaaattgacaccctaacatcacaattaaaagaactagagaagcaagagcaaaaacattcaaaagctagcagaagacaagaaataactaagatcagagcagaactgaaggagatagagacacaaaacccttcaaaaaatcaatgaatccaggagctggttttttgaaaagatcaacaaaattgatagaccattagcaagactaataaagaagaaaagagagaagaatcaaatagatgcaataaaaaatgataaaggggatatcaccacagatcccacagagatacaaacaaccatcagagaatactataaacacctctatgcaaatgaactagaaaatctagaagaaatggataatttctcgacacacacaccctcccaagactaaccaggaagaagttgaatctctgaatagaccaaaaacaggctctgaaattgaggcaataattaatagcttaccaagcaaaaaatgtccaggaccagacggattcacaggtgaattataccagaggtacaaggaggagctggtaccattccttctgaaactatttcaatcaatagaaaaagagggaatcctccctaactcattttatgaggccagcatcatcctgataccaaagcctggcagagacacaacaaaaaaagagaattttagaccaatatctctgatgaacatcaatgcaaaaatcctcaataaaatcctggcaaaccgaatccagcaacacatcaaaaagcttatccaccatgatcaagtgggcttcatccctgagatgcaaggctagttcaacatatgcaaatcaataagcgtaatccagcatataaacagaaccaaagacaaaaaccacatgattatctcaatagatgcagaaaaggcctttgacaaaattcaacagcccttcatgctaaaaactctcaataaattcggtattgatgggatgtatctcaaaatcataagaggtatttatgacaaacccacagccaatatcataccgaatgggcaaaaactggaagccttccctttgaaaacgggcacaagacagggatgccctctctcaccagtcctattcaacatagtgttggaagttctggccagggcaatcaggcaggagaaagaaatagaaggtattcaattaggaaaagaggaagtcaaattgtccctgtttgcagatgacatgattgtatatttagaaaaccccatcatctcagcccaaaatctccttaagctgataagcaacttcagcaaagtctcaggatacaaaatcatgtgcaaaaatcacaagcattcttatacaccaataacattcaaacagagagccaaatcatgagtgaactcccattcacaactgcttcaaagagaataaaatacctaggaatccaacttacaagggacgtgaaggacctcttcaaggaggactacaaaccactgctcaacgaaataaaagaggatacaaacaaatggaagaacattccatactcatggataggaggaatcaatattgtgaaaatggccatactgcccaaggtaatttatagatcagtgccatccccatgaagctaccaatgagtttcttcacagaattggaaaaaactactttaaagttcatatggaaccaaaaagagcctgcattgccaagtcaatcctaagccaaaagaacaaagctggaggcatcacgctccctgacttcaaagtatgttaagtcttgagttccttcctaacatttctcttttgcttaacctacctggtcttgtgtgtcatttttttttctttggtttttctttttcttggagataggatctcactctgtggctcaggctagagtgcagtggcatgatcgcagctctttgcagcgttgaccttccatgttgaaatgatcctcccaactcagcctccggagtagctggcaccacaggttgcacaccaccattcccagctaattaaattgttttttttttttagagatgagatctttctatgttgctcagactggtctcaaactcctgggctccagtgatcctcccaccttggcctttagagtagctgggactactcgagggcacacaagtttgttgtataatatttaattttgtcataaagtatagttgtcaaagataatgatatatacatattaaatatatgactaaaagtatagggacctgtgtagactcatctgcttctatgacagtaaaataaaaaaaatagacttcatagtttgaggttcacaggaaaattgagcagaaggtacagagaattcccatttacctcctgccccaatgcatacacagcttctctcattatcagtatctcccaccagagtgtatattcattacagttcatgagctcacactgacaaatcattatcaaccaaagtcatagtttacattagcattcactgtcagtgttggacattctgtgggtttggacaaatgtatcattacatgtatccaccattatagtatcaacagaatagtttttttaacctaaaaatcccctatgctctgcctattcattctttcctctccctacccctgccaaccactgatctttttactgtctccacaattttgccttttcccaaatatcatatggttgtaatcatacagtatgtagctttttatgattggcctttttgacttgacaagatatgtttaagtttcctccatgtctttttatggcttgatagctaattccttttcagcactgaataatattccattatatggatgtaccacagtttgtttatccattcacctactgaaggacatcttggttgcttctgtaaaatttgtttaaattttagtaagtcacctgagggaaaaaggcaactttgaaaagaactgatctcttaaaatggcttccaaacattgggatagaagagcaatttttataacacatgaaaagcaagatataagaaattgaattcatgttcatgtgtaaagaacacaatagaacagtaattttcaaagtactctgttttatataacttttaaaaaatctgaggaggctgaggcaggagaatcacttgaacccaggaggtggaggttgtgagccaagatcgcaccattgcactccagcctgggcaacaagaatgaaaatccatctcaaaaaaaaatctgaatgatgggaggtctttggttgaaagcaacagaaacaatctggcttacttgagcagaaaagtcagttattggaaagtatgcagagacagagactgctgtctcctagcattcattatagaattctcattgtaatagaattctcatttagctcagcacatggccttccatctacataccaaatttctcatgctgccttgcagctagtatggctatgttactgtattagtctgttttatgctgttgataaagacatacccaagactgggcaatttacaaaagaaagagatttaatggacttacaattccacatggctgggggggcctcacaatcatggcacaaggtggaaggcatgtctcacatggcagcagacaagataagagagcttgtacagggaagctccccctttttaaaaccatcagatcttgtgagtcttatttgctatcatgagaatagcaagggaaagacctgcccccatgattcagttacctcctactgggtcccgcccaaaacacatgggaattcaagatgagatttgggtggggacacagccaaaccatatcattctgccactggcccctcccaaatctcatgtcctcacatttcaaaaccaatgatgccttcccaacagtcccccgaagtcataactcatttcagcattaactctaaagtcctaagtctcatctgagacaaggcaagtcccttctgcctgtgagcctgtaaaatcaaaagcaagttagttacttcctagataacaatcagggtacagccattgggtaaatacagccattccaaatgggagaaattggcaaagcaaaggggccacaggcctcatgcaagtctgaaatccagcagtgcagtcaaaccttaaagctccaaaatgatctcctttgactccaggtctcacatccgggtcacgctgatgcaagaggtgggctcccatggtcttgggcagctctgctcctgtggctttgcagggtttagtcccacctcccacttgctttcaggggctggcattgagtgtctgtggcttttccaggcacatggtgcaagctgttggtggatctaccattactggggtcttgaggacagtggccctcttctcacagctccactaggtggtgccccagtagggactctgtgtgggggtccaaccctacgtttcccttctgcactgccctagcagaggttctccatgagggctctgcccctgcagcagacttctgcctgggcatccaggcattttcatacatcctccgaaatctaggtgaaggttcccaaacctcaatttttgacttgcatgtacctgaaggctcaacaccacatggaagctgccaaggcctggggcttccaccctctgaagcaacatccagaactgtaccttggccctttttagccatggctggagtggctggaatacagggtaccaagtccctaggctgtacagagcaggggggccctgggcctgagccatgaagtcatcttttcctcataggcctctgggcctgtgatgggaggcgatgctgtgaagaccactgacgtgccctggagacattttccccattgtcttggtgattaacattcagctcctcattacttatgcaaatttatgcagccagctttctccttataaaatgggattttcttttctatggcattgtcaggctgcacattttccaaacttttatgctgtgtgtcccttttaaaactgaatgcctttaacagaatccaagtcatatcttgaatgctttgctgcttagaaatttcttccaccagataccctaaatcatctttctcaagttcaaagctccacaaatctctagggcaggggcaaaatgccacgaatctctttgctaaaacaaaacaagagtcacctttgttccatttcccaacaagttcctcctcatctccatctgagaccacctcagcctggatttcattgtccatatgattatcagcatttttgtcaaagtcattcgacaagtctctagggagtccacactttcccacatttttctatcttcttctgagcctttcaaagcgtttcaacctctgcctgttacgcagttccaaagtcacttctacattttcgggtatcttttcagccgcgctccactctactggtaccaatttactgtattagtctgttttcacactgctgataaagacatacctgagaccaggcaatttacaaaacaaagagatttaatggacttacagttccacatggttgtggaggcctcacaatcatggtggaaggtggaaggcatgtctcacatggcggcagacaacagaagaaagattgtgcaggtaaactcccctttttacaaccatcagatcttgtgagacttacttgctatcacgagaagagcacaggaaagacctacccccatgtttcagttacctcctactgggtcccttccataacgtgggaattcaagatgagatttgggtgaggacacaaccaaaccatatcagttactaagtttagattggtaggatgtgagtagaaaatctgtatgcaaatattagatcattcagatattttcctatggctgataaatggcaacaactataataagtagcactggcccattcatctctagaatgttcattagagagaaataagcttttcccttcttttagcaacttattttgcttcactcaacctgttctctgaataatacaaaaggatattgagtagctcacaagagaaatgagaagactggataaactattgttggaaagaggccagatacaaataaaggctagcctacagcaaagatgaagccaatggaaagtttgagtaggatattcctgtcattgccacaggatcctgggttactaccactggcaccctttcagtaggtactgcatgctacaggaatggagagaaagaattgtaaattgcctttacatctttgcatcacttattaagactgagtcctgcttaatagtatctgcttggctaaacctaggtcttgtccataccgtggctgcctagagatatgaaatagggaatttaacttttctgttatatgtagtgaaagaggttctctttctggacaaaatccacacaataaaggattctcccaaacacaggaaaggggattcaaatgattgagattcccaaacaaataaaaaattcaaataatatatttttagctatagattgttaccataattaacaaggaatgggctaatttgttctctcatgtctactcagagaaactttgtaatgtggactagatgtaggggtagacaggttaagagacaaaccagcaagcttcagcatacaattttttcttaatgtattacaacagattttttttcctattctacagagaacagtgaaaaacaggtcaccatcatttatatgtaagagagttgcttaactgttatcaaattgttcctgttccttttctattccagaatgtcctgctcaatcctattgctcgattcttttaaatgtcttcaggacatttttatgtttttagtattcctttttaattcaattcagctacagttctcatataaggattgaagttggctgttttaaactcttaaattattgattgaaatacagtatctggaaatgtaaatcatgtaatttaatagttttgttgcgtagtgcctctgatctttatttaaagtcacactttattgtaacttactccagtttctcagatgctctttgtccttcactatctcaagacctttcttaattccaaagttcttcctagaaaacccttaccccattcatattctaagtccaggtcagatccccctgtaatatgctgtcataagaccctatcttttaaatttatatcatttatccctgtttataattatgtgcttgtatgattctttgattatctttcccagtggaatataaactccaagaagttaagaatgattatgttttgatcatctttgggtttccagaacctaatatagtgcatggcatgtactagccacttgcatttgttgttgttattgaatgaatgaattagaaatgtattagtttactagtatagtgatatgtagacattcaactagagatgttttataaggttattactctaataaactatgttatttacttcctgtataattacttctgaacattgagataagcaattgaatttgaacattttttaaaatgttattttatcaagcattggttcttggaatcttggtcttattttgtttcaatcctttggttttagattttaacatttgccattgggtggcagtattgactaccagaaaactcacttaaactctggcattcaagttgtagaaacttggtagttttgtttgacttagaaaaatgtaaaaactttcaactcaaactcatgaatattttatctgaagtattttatctgggttagtcatataacatataaggacatatttagttattttaggatagtatacacatgagattataggttgccttgtagaaattcataaagtagcttacattttcctttagaaatataataataatgaacacggtcaatctatttcttctcttttaactttgaggagggagaagtgacaggtaatgcgtttaattccgttaaattcttcccacttagcaaaaacagcagatctgacttttttgtgagagctaataaaattaaatttttactcttaacctactaagaaagttgactgtttgaaaataaaagcagcattaaaatgtatatatgacagccctttttcatgaattcatttatttatctttttcatttattaatgtaacagtttctttttttgagcttctattaagtgctagagactgctctaggtccttgggatacatcatggaacaaagaagacaaagatccttgtggaacttacattcaagctaggagagacagaccctaaataataaatatacattatatagtatgttagaaggtgataagtacaatggaaaattaaagtagaacagagaaagaggaatagaaagatctgggggttacatttaaaatatgatgatatgcttaggttttatggagaagttgacatgtgagaaaagactttaagcaagcaagagagttcaaccatatagatatctaggggaagaacattctaggcagagacctgtcagttcaaagaccctaaggcaagagcaagccaggtgtacataaggaccagtaaaaaggccattgtggctggaattgaattactgatggggagattagtcagatatgaacttagaagttacacaacaagggagatggttggggatgtggaattaaggggttgctggaggggatggagattcctgaaggatggagctatatcagctaaatattcttagctttgtagaccatagtgaggattttgactcttaccctaagtgaaatgagggagccattgaaggattttgagcagaagattagtattatgtggcttagttttataaagctcctattggtttccacctgagaatagactgtagtagcagtataccagttcagaggctactgctataatctaggtgagagatgatgatgatggtagcttggacaggttggtagctatggaggtggtgacaatggcttgaatactgaatgtgattttaatgcaggattaataggatttgctgatggtctagatgtggggggtgagggaaagaagagtcaaagatgactaaggtttttggtttgagcaaatggaaagacagagttgtcatcaactaatatgaggaagattttaggaagaatatttggttatggtatgccaagttagagatatctttgagatattcaaaaggagatagtgaggaggcagttggatatatgggtctggaaattgatggagagagatctgtactgtagatataaatttggaggtgttcgcttaaatattaaattggaaaccattgatgaaattggatgagattaccaggaaagttagcatagagagagagaatcgaaccaaagactgaactgtgggtcccaacaaaattcagagtatcctgtgctaggcatataaattcctttcttagataagcttgccttatgttgaactatttataaccacttattttgttgcctctgactttataagattttgttgcctctgactgcataggacaatgtaaaatgaacaaatcctgctctcaatatagctaattctacgtttgtcattttcagctgatcagaaccaaggtcttaaatctttcttgggattttttttttttatagtgtgtattgccctgtccatactcttaacatggtttatcaattttcttcaaagcataatatcttagctcaggctgctataacaaaataccacagattaggtcgcttaaacaataggcatttattcctcacagttctggagaccagaagtccaataccagggtgctatcatggtgagggccaccttcctggccctctcactctgccacataaagaacgaacaagatgactgcctttttgttctatccttatatgacagagagaaggagaggaggagagagcgagagcaagagagagccagagagagagagagggagagagaacgcacgtgagagtgcgaacttgtgagagctggagagagtgagcaagctctctggtctctccttgtaaggcactgatctcaccatgaggaccctaccctgataaccttatctaaatctaattacctgtccagagccccacctactaatactatcacgttgggagttagggtttcaacatataaattttgaagggacacaggcattcagtcaataatatgagaattttttttgtttcttttttttttttttttgagacagagtctttcactgccgcctgggctggagtgcagtgggctatcttggctcactgcaacctccgcctcccagtttcaagtgattctcctgcctcagcctcccaagtagctggattacaggtgcccaccaccacgcccagctaagtttttgtatttttttttttgagacggagtctcatgctgtcgcccaggctggagtgcagtggcgcgatctcggctcactgcaagttccgcctcctgggtttacgctattctcctgcctcagcctccggagtagctgggactgcaggcgcctgccaccatgcccgtctaattttttgtattttttagtagagacggggtttcatggggtctcaccgtgttagccaggatggtctcgacctcctgacctcgtgatccgccttcctcagcctcccaaagtgctgggattacaggcgtgagccactgtgcccggccaattttttgtatttttactagagacggggtttcactacgttggccaggctggtctcaaaactcctgacctcgtggtctgcccgccttagccgcccaaaatgctgggattacagacgtgagccaccgtgcctgggccatgaaaattcttagcatgaatatttcttaatgttatttcaatttatggaggaactattctctattcacaattaaagttatcttgggaaagtcaattaactatctggttataaatttcattatttatacaaagagattatttgcccttgtctgagtcttgggatgataacttgatcaaagtgaattgaaatagtgtcttgctgtttatgcttgactggctgataatacagtagcagtttcctttttagtaagtagacattttgtaatagtttgatttagtaaaatcttctgtttgcaatgaggttcagtacattttattaataaaaaaattgaatttgtgattaatatttatatattaggcaactatttacatattctgtgagcattatacatgcaccagtctaataaaatgggcagtttaacttttgtacctagaagaaattttgacatacatgctttcattattttataatttattattttagatgtttttgaaatatgattttgacagttacgattattcaaaaatctggtctttaaaatttttgaagttagtcttttctaagcatacatattttgataataccaggagttttcaaaatgtgtggtgcaagggttatataaggagatgggttggggtaggatggaagataagtgactcttccttttctgcctcaaccatagtgtcatcactttgcaatattttacatattgagattccttgtaaaactttgttttaagccttctgcagcccaaaaagagtaaattggaaaccattgatctttaaacaagagggcaatttgtttccatgccacaatagcatcattgaccgaaactgtaagagccaagtattcttggaacagatctagtataatgattaccactcacacaattcattgtcttataaaattaacagattgtcagaatagttgtggatatttaaaatagacaaaagttaatacctggcctttggagattgattttatgggtctagaacatgtgtagaatactttggatactgtaacaaaatcaaatttttaaaatggtgttagaagagagaacacttgcattgaaatcttgttttgacttttattggagaacttcagattcagtacatactaaatcataagactatatctggaatgattacaacaagctacatttacccctcttgctctaaaaatctttattcccaccatatcttccacttcttattaacaatccagtttcttctgggaaattgccttttgctaacgtagcatagtcttgctgggatgaaaaaatccaggtacctgtctattctaagcttgatttttctccttgaaaaactctctgaatttctacatattttttcaatacagtcccattttcccttaagctagccaaattaatttctgtgactcacatgtaagaaaacaaactgaagtaccaccttagagatactgttagggtgtgttttttttttctggttattagacttctttaaaatacccaaaattatatcagcaacctgcatttgatagaattcagagttagcaatatttatttaatgtgttcagttgaaaactgcaaaaagaaaataaatatagttggctctttaaacatgtaccacttcaacattaaaatgaatgcttttttcgtagtagtatagatgaaatataaattaagggtatgagccaaaattacatcaaaaagtctaaaatcctggagtaagattattttttgcttactttcccttttacttattttttattgatacataatatttacatatttatggggtatatgtgagtatttgttatccgcatagaatgtgtaatgatgaagtcagggtatttggggtattcttcactttgagtatttatcatttctgtgttgggagcatttcaagtgctcttttctaactacttagaaatatacaatatgttgttgccaactatagttaccctacactgccattgaatattataatttgtatcttctaactatatgtttgtatccattagccaatgtctgtcctcccccactacccacaccctgtccagcctctggtatccatcattctattctatacctccatgagatcaactcttttaactcccacgtgtgagtgagaacttaggatatttgtctttttgtggctagcttatttcatttaacataatgacctccagttccatccatgttgctacaaatgacatgatttcattcttttttttttttttgtggctgactagcgttccattatgtatatacactatattttcattatccttttgtctgttgagggacacttaggttgattccgtatctttgctactgtaaatagtgctgcagtaaatatgcaggtgcaggtatctctctgttacagtgattttgtctcctttggataaatacccagtagtgggattactggatcatatgatagttctattttaagttttttgaggagtttccatactgtttaccatagtggctgtactaatttacatccctaccaacactgtattaagagttcccttttctgtgtatccttgccagcatctgttatttttagtctttttaataataaccattttaactaagatgatatctcattgtggtttttgattggcaaattccctggtgattggtgatgttaaactatttttcatgtacctgttggccatttgtaagtcttcttttgagaaatgacttcatgatctttgctcacttttaaataggattatttgtttactgttcagttgtttgagttccttgtatatcctggattttaggtccctgtcagtaacatagttttcaaatattttctcccatcctgcaggttgtcttttcactttgtggattgtttcctttgctgtgcagaagctttttagttgaatatagtctcatttgtctatttttatttttgttgcctgtgcttttgaggtcttagccaaaaaatctttgcctaggtcaatgtctcaaagcattttgcctatgttttcttctagtagtttgatagttttgggtcttagggtttaagtctttaatccattttgagtttatttttgtatatggtgagagataaggggtgtagtttcattcttccacatgtgaatatccagtattcccagcacaatttattgaagagactgtgctttctccaatgtatgttcttggtgtctttgaaatcagtgagtataaatatgtaggtttattctttcactattatgtttcattgatctatatgtctggttttgtaccagtaccatgctgttttggttactatagccttgtaatatattttgaagtccagtggtgtgataccttcagccttattctttttgcttaggatttctttggctattggcctcttttttggttccatatgaattttagaattgttttttctaattttgtgaaaaatgactatggtagtttgcattgactctgtagattgctttgggtagtatggtcattttaacaatattaattctcccaatccatgtacatgggatgtctttccatttgtttgtgtcctcttcaatttctttcttctgtgttttgtagttttcctatagagattgtccacatgcttggttaaatatatttctaggtattttattttttttgtagctattgtattgccttcttgatttctgtctcagctagttcattatttgtgtatagaaatgctgcagatttttgtatattggttttgtaacctgcaactttactgaattcatttattacatttaagagttttttggtggaggctataggttttctagatataagattatatcatcagcaaagagtggcaatttgacttcctctttccagtttggatgcattttctttctttctcttgcctaatttctctggctaggacttgaagtagtatattgattaggtggtgaaagtggacatctttgtcttcctccagttcttagagaaaaagcttttggtttttctccatttggtattgaagtggcatcatttggggaaatagccaaggtttgttgtctcgcactaaggaaatcgaagacgtggacacacaatgagtgggtttaagagcagaaagtttaataggcaaagtaaagaagagaaaagctcccctgtgcagagagagtggtgttctgaatggatctccctctttgaggccagatgcgttttttttttttttttttttctttctaagaatctgactctgtcgcccaggctggaatgcagtgatgcgatcttggctcactgcaacatcctcctcccaggttcaagtgattctcctgtctcagcctcctgagtagctgggactacaggtgtgcgccaccacacccaggtaatttttgtatttttagtagagatgaggtttcgccatgtttcacctcctgacctcaggtgatccacctgccttgggctcccaaagtgctgggattagaggtgtcagccactgtgcctggctgtggttggttttatagaggggcttttggaggcggtgtctgatttacatagggcccagaggatttgttggaccaggtgtaccatttgcatagtgcactaagaggctggccatcccaccctaatcttttattacgcagatggggtcttttcctggccagtgtagacgcctgcacacatggcaacaaaagggaagggaaaatctccatgttgaatatacctggcttccaggtatcccttttctgttggcacagcttccagcattccagcttgcttatctatgcttgcagcttgatttttcaggctgctttttgttagaaaagaaatgattttggggctgtttttttttaaaaggaaattccactgagaactcttttacccttactaactgcctgaataatttctttttaactcctgtaacagtatgatattaactgtgggtttgtcgtatatgtccttttttatatcttggtatgttcctttcatgcttagtttgttgagagtttttatcgtgaagggatgttgaactttatcaaatgctttttctgcatctcttgagatgataatatggtttttgttcttcatgttgctgatatgatagatcacatttattgatttgcatatattgagccatccttgcatccctgggataaatctcacttgatcatggtttattatttttttaatatgctgctggatttggtattttttgagtatctttgcatctgtattcatcagggatgttggcctgtagttttcctttttttgttactttaatatttgggtttggtgttaggttaatcctggccttgtaaaatgaattagggacaattgtctccttttcctttttttttttttttttggactagcttgaggagaattggcattaattcttctttgaaagtttggtggactttggccgtgaagccgtcctgtcctggactttcctttgttgggagactttttattactactttgatcttttcagtttttaatggtctgtttaggttgtctaaatattttttcttgattcaatcttagtaggatgtatgtgtctaggaatttgtggattttctctatgttttccagtttgttagtgtatagttatttataataatctttgataatcttttgtatttctgtggtatcagttgtaacgtgtccttttacatttctgattttgttgatttgggttttctaatttttttttgttgttgttgcttaatctagcaagtggtttattggtagaccacatcttttcatgttgatcctttgtattttttttttccacctctatttcatttagttctgcttttatctttattatttatcttcttctagtaattttgagtttggtttattcttacttttctaattctttgaggtgcatcattagttcattttaaacctttctgcttttttgacgtgggtacttattgctgtaaacttccttcttagcattgcttttgctgtatccaatagcttttagtatgttatgttttgattttcatttgtttcaaaaagtttttttattttctctttaatttattctttaatcctttgatcatttaggaacatgtttttaaatttgcatgtatttgtacagtttccaaagttcctcttttcattgatttctagttttatttcattgtggtttcacaaggcatgattttgatttttaaattttttttgaagtttttttattattatactttaagttctaggacacatgtgtacaacttgcaggtttgttatatatgtatacatgtgccatgttggtgtgctgcacccattaactcatcatttacattaggtatatctcctaatgctatccctccctgctccccccaccccacgacaggccttggtgtgatgtttcccttcctgtgtccaagtgttctcattgttcaattcccacctatgagtgagaacacgcagtgtttggttttctgtccttgcgatagtttgctgagaatgatggtttccagcttcatccatgtccctacaaaggacatgaactcatcattttttattgctgcatagtatgctatggtgtatatgtgccacattttcttaatccagtctatcattgatggacatttgggttggtcccaagtctttgctattgtgaatagtgccgcaataaacatacgtgtgcatgtgtctttatagcagcatgatttataatcctttaggtatatacccagtaatggaatggctgggtcaaatggtatttctagttctagatccttgagggatcgccacactgtcttccacaatggttgaactagtttacagtcccaccaacagtgtaaaagcattcctatttctccacattctctccagcacctgttgtttcctgactttttaatgatcgccattctaactggtgtgagatggtatctcattgtggttttgatttgcatttctctgatggccagtgatgatgagcattttttcatgtgtctgttgactgcctaaatgtcttcttttgagaagtgtctgttcatatccttcgcccactttttgatggggttgtttttttcttgtaaatttgttggagttctttgtagattctggatattagccctttgccagatgagtacattgcaaaaactttctcccattctgtaggttgcctgttcactttgatggtagtttcttttgctgtgcagaagctgtttagttagatcccatttgtcaattttggcttttgttgccattgcttttggtgttttagacatgaagtccttgcccatgcctgtgtcctgaatggtattgcctaggttttcttctagggtttttatagttttaggtccaacatttaagtctttaattcatcttgaattaatttttgtataaggtgtaaggaagggatccagtttcagccttctacatatggctagccagttttcccagaaccatttattaaatagggaatcctttccccattaattgtttttgtcaggtttgtcaaagatcagatggctgtagatgtgtgatattatttctgagggctctgctctgttccattgatctatatctctgttttggtacctgtaccatgctgttttggttactgtagccttgtagtatagttggaagtcaggtagcatgatgcctccagctttgttcttttggcttaggattgtcttggcaatgtgggctcttttttggttccatatgaactttaaagtagtttttttccaattctgtgaagaaagtcattggtagcttgatggggatggcattgaatctataaattacctttggcagtatggccattttcacgatgttgattctccctgtccacgagcatggaatgttcttccatttgtttgtgtcctcttttatttcattgagcagtggtttgtagttctccttgaagaggtccttcacatcccttgtaagttggattcctaggtattttattccctttgaagcagttgtgaatgggagttcactcatgatttggctctgtgtttgtctattattggtgtataagaatgcttgtgatttttgcacatgattttgtatcctgagactttgctgaagttgcttatcagcttaaggagattttgggctgagatgatggggttttctaaatatacaatcatgtcatctgcaaacagggacaatttgacttcctcttttcctaattgaataccctctatttctttctcctgcctgattgccctggccagaacttccaacactatgttgaataagagtggtgagagagggcatccctgtcttgtgcccgttttcaaagggaatgcttccagtttttgcccattcaatatcatattggctgtgggtttgtcataaatacttcttattattttgagatacatcccatcaataccgaatttattgagattttttttagcatgaagggctgttgaattttgtcaaaggccttttctgcatctattgagataatcatgtggtttttgtctttggttctgtttatatgctggattacgcttattgatttgcatatgttgaactagccttgcatctcagggatgaagcccacttgatcatggtggataagctttttgatgtgttgctggattcggtttgccaggattttattgaggatttttgcattgatattcatcagagatattggtctaaaattctctttttttgttgtgtctctgccaggctttggtatcaggatgatgctggcctcataaaatgagttagggaggattccctctttttctattggttggaatagtttcagaaggaatggtaccagctcctccttatacctctggtagaattcggctgtgaatgtgtctggtcctggacattttttggttggtaagctattaattattgcctcaatttcagagcctggtctattcagggattcaacttcttcctggtttagtcttgggagggtgtatgtgtccaggaatttatccatttcttctagattttctagtttatttgcgtagagatgtttatagtattttctgatggtagtttgtatttctttgggatcggtggtgatatcccctttatcattttttattgcatctatttgattcttctctcttttcttcttcattagacttgctagcggtctatcaattttgttgattttttcaaaaatccagctcctgctcctggattcattgatttttttgaagggttttttgtgtctctatctccttcagttctgctctgatcttagttatttcttgtcttctgctagcttttgaatgtgtttgctcttgcttctctagttcttttaattgtgatgttagggtgtcaattttagatcttttctgctttctgttgtgggcatttagtgctataaatttccctctacacaatgctttgaatgtgtcccagagattgtgtgtctttgttctcattggtttcaagaacatctttatttctgccttcatttcgttatgtacccagtagtcattcaggagcaagttgttcagtttccatgtagttgagcagttttgagtgagtttcctaatcctgagttctagtttgattgcactgtggtctgagagacagcttgttataacttctgttctttcacatttgctgaggagtgctttacttccaactatgtggtcaattttggaataagtgcgatgtggtgctgagaagaatgtatcttctgtcgaattggggtggagagttctgtagatgtctattaggtccgcttggtgcagagctgagttcaattcctggatatcgttgttaaccttctgtctcattgatctgtctaatattgacagtggggtgttaaagtctcccattattattgtgtgggagtctaagtctctttgtaagtctctaaggacatgctttatgaatctgggtgttcctgtattgggtgcatataaatttaggatagttagctcttcttgttgaattgatccctttaccattatgtaatggtaaaggataccattcttcgaagaagaaaggtagcttctttgtctcttttgatctttgttggtttaaagtctgttttatcagagaaaaagaattgcaacccctgcccttttttgttttccttgagttttcttttgtgtcctaacatatagtctatcctggagaacattttatgtgctgatgagaagatgtgtattttgtagctgttgattgaaatgttctgtaaatgtctgctaggtccatttggtctaatgtgcagtttaaatccaatgtttctttttctgtctggatgatctgtctaatgctgagagtagggtgttgaagtccccaactgttattttattggatcaaataacactggtgccaagaaacggtgccagggagcccaagacaggcactcttagactgccactgtcacccctacggcccaaagattggcccagggccaatttctccctttaaatgtattaatttcttcctttaaatgtaataatgtttgctttatatgtctaggtgctccagtgatggctacatatttgtttagaattgttatatccttttgctgaattgatccctctatcattataaaatgaccttctttgtctctctttattgtttttgacttaacatctgttttatctaattagagttactcttgctcttttctagtttctgttttaatggattttttttctatccctttattttcagcctctatatgtctttacaggtggtatgagtttcctgcagttggatcatgtttttctttttttttctttttaaaaaatccattcagtcagtctgtgttttttaagtggaaggtttaatttgtttacaatcaaggtttctattgatatatggggacttaattatacttaatttttttgtgtataaaatgagaaggttgtcttaataataacaaagttactattatgaagcatttattatagtattaaatattaagcattttacttagaatctcattttatatttagaaaaatcttatattctaggtggaagctccacaattaaactgaagcttagagaaattaggtaagtttgcccaaggtttcacagctagtaagtaggaaagctagatttgactgcatagctcatgctgttactcctttacagcttaaggtgcttttcattcatccatccattgattgattgattccataagtgtatactgaggctaatcattagtaattgttggctatgttaagtacttttcattgtattttattatgatgggaagtcactgaaggattattagtaggggaatgataggagtagaattatgtttttaatcattctggttgcattctggatagttgaatgttataggaaagggataagtatggaaataagaagaccaggttttagactattgcagtagtccagttgagagtgggtggtggcttggactgaaatggtagttgtagagacagggatcagtggttggggtatcgtggggtgctagaatttaaaaattcttataattagtaagatacagaccagacaccaatcaaaatggatggtggccattggactagagtaagatcttgatgtgccgtgttgtgccaggcattacccctctagttatctattgtagggaggtttgaattatctcaagtgaggagtcaggggaacagggacagcaagactgataacgtgcgatgctgaggtacatctacttaccaacagtcattgaaacttttatactttaacatgtggaaagactgtaatccctgcatacctaattaatattcagtttgtttgtgggttggttgtatggggtgctggagaaagaggcaacttaagaatggcaccaaagtttttgccctgagcaactggatgaatggaagtgccgtttactcagctggcaaacactgctgaaggaattggtttgggaggaaacgatcaaggttttagttttatacatgtgaagtttgagatgaccctctatagatatccaagtggaaatgtaaagtagtagtttgaattcatgagagattgtggggctggacatatacatttgggatatatcagagcacaattctactctgtatgattatgtagtagctttttcccttaaaaaatctctcagcagcccgacactaatgcttaaagttacagtgttagaaattcatttatactctttggttttttaaaactgtgcataacctgcggagaagattctttttgaaattgcactataaggtgaatttgtttattacaccctttaaaaaacagctgagatatactaccttgagaaattgtcatactgattgagaaaagtaatgcagagagagttatggggatatattgcatgagatactaaagtatgaagtggtagaataatttttatggatatatttttataaaaaaggagtcttgcacatatagtatgttcttattcataagtgggggctaaaaaagttgatgtcatggaggtagagtagaatgatggttaccagaggctgggaaaggtttcggggagagagggatgacgagaggttggataatgtatacaaaaatatagtcagacagaggtaatatgttctagtacaataacatagtagggtgactatagttaataatttattatatatttcatagctagaatatttggaatgtttacaacacaaatgtgttcgaggcaacagatatcctaattaccttgttttggtcattacacattgtatacatgtatcaaaatattacatgtagaccataaatgtgtataattgttcagtatcagaaaaaaaattttaaaaagtggactcttgcttagatgtccttaagtgtagatattagtattagctgtttaatgggtggggaagtctttttgtcgttgtttgtgttttaaattaatattcagttaattagtatacattttaagtcattttggttatagaatacagaaagcttcaaattaagacatctaatttttttcttaaatctttgaattatatttataaatcttgtcattctatttataaatggattaatttagagtaaaataaagacaacatatagattgggctacagacctataacatcctggaactgcattccctgcattcttgcctccttgcctgttcctctatcttcagatccgggactgcagcatcttgctttgatagtcacattgcttccttctgcagtcaaatctccctctcttataaggacacctgtaattatatttagagccaatttagataattcacgataatctctcccaaatttcaaaatccttaatttaatacatctgtaaagttccttttgccatataaggtaaaatccaaagcttctggtggttaagacctggatacctttgagggctattattcagtccactggaaacttgttctgcagtattttgctttaatgcagatttgataaatatattggtgatttaaaaatgtacccaattttcaagatttttttcatgccagtgttctctatcaaactcttttccaagtaatacccacatattacttggctgctttcaactctgtgcctttgggtggtggcctgtttttaatgttttatttagaaataattttaaagttttagaaaagttatacaagaataagaatagtacaaagactatctgaatgtccgtttcccagattcacctattaacattttactctattttctttggtataactgacttacatgttaaaataaatctatatttccttttatgaaaatagatacaacatttataccaatagatgcattatatataatttctatatgatttcatgtcttttcagttaaattagaggttggcaaacttttctgtaaaaggccaggtagtaaatactttttctttgcaagttacatggctctgttgcaaccactcagctctgctaaagcagccatagacaatacttaactgaatgaacatggctgtgttttaataaaactattaaatgatttctaagttactgtaattaaattaaaaaagaggttcctttaatatctctgattactaaggaatagttcacagtcttttctcactcagaaataatagttttctatagctgatttaaaatattatcattatcaaagagataatctgagatacttcctagtttgtacctgaaaaatacagagccatacaatgtaagcattgaaaaaaatcttgaagatgaatcaattaatacctgggtgagtgaacacatgaagacatgaaaactgtatgggtcaatatttcttaaatcagactctgcttgggagttttaaaattttgttattaaatgacaatctaaaactttttgatataagcaaattgaagattaactgcctgatctcataattgagtaatgccactgtattgtaatgccagcagttgtgttgacaatttaaagttgggattaagtagtatccctttaattactgtaggctaaaaacaatacaactaaagtgtactaatacttttgtgacaagtgaagggtaaatgattatatgccatagtatatgaatttaaaagatttgtaaaaagtaggttgaagaaaaatggtgggagaattatgttgtcaaaataatgtaggtgtgctaaaattatgtaaaaaaggcattatgagaattaatatcatttttaacttgggacccattattttaaacaaaacaatattatcatattcagtaaatattagttttataaatttacttatatataatttataaatgtatgtttgttttatgcttataaaagaaatttaaacataggagtttatgtctagtatttgagaattttttagtttcattaaaattaaaatactttgtgagccctaaagtttgatgaaaatatattccctttaggagaattccttctattatgtttgagaaacactgatggggaaaccaagacttatgagtaacatcatgaatatggaaaggaaaaggctgtgttttcaactttatagtatttgaaattattctgcactaatttaataatttttattttatgatgcataatttttttttctttttgaggactccactgaagcaaactttggttgtccttaataatgctaaaaaaaatgtaatcttttttatgtttgtttaatagttaataatttttaaactttaatttttaaatgcttttacttccactattttaaaaaaataaatatttattataacccttggtggtagattattatatccatttgtgtagatggaggcttgatgatgaaagaggtaaacatacttccctgacagaactgatatttgagtacattgttttctattttaatactcttgtagcatactaaaataaatctgacattttatattatttaaataattctttaaaattgtgaaatttatttgaacatccaagtccgattgtgagtatatgacttttttcgcctctaagcattacattttctgtgagtattattcttgtaagttatatttcagataatttatgtatatatttgttaatatgataaacattgaattcttaaattctcttaatccatatgttgtatttctataatctgagggctttgtttaatctagtgtgttgtttcattttttttttaataggtcctgattgttctttgaatgttccctctactgagtcttactggattctgccaaacgttaaacccttcagtccttctgtaggtcgggcttcacataaagcagttttacacgggaaatttatgtgggtgattggtggatatacttttaactacagttcttttcaaatggtcctaaagtaagtatttattttcagattcttgctgttttttaagctggatttttatccaaaatgtcttttttttttaattgttgtccgagagtaaaagtggttatttttgtggtagtgtctatttgctagtgagactgatttgtgaatacatgaactcagtatgtccatagctgtcattgcacatagaagtatgcttcatgtagaaatgttattacttctctagagtacttttaataaattctgagtaagaaaatattaacttcaaatacaggcaggccttgcctataatggataaaatgaatcaaatgaatcatgccacctttttttttaatgaagtataatctcatatataaaaatcctctcaatttgttctgtaaattttagtgtacctgaactttactttgtatgtgctttacaaactttcattgggagaacagttctagtattatgagagagatgattgatttactgttggctcaatagagattgttctctgcatgattggataaggggaatcatatggatggcagctttatctgatttctttttcagctaatgattgtattttatgaactgtttagtaacaatacaaaaggaaatagggagaatcatttgatttttaatgttgcttccaggggtagtgttcatattatgtaataactggtacagcttgggcatcaaacaatcagaacttgccctggacagtatggcataatggtgtatacacaatagaattgccagatttagcagataaatatacaggatacccagttaaacttgaatttcagataaaaaacaagtacatttttagtataagaaggcccttttgctgtatatatatatattttttacaaattttgcatgggtcattctttaacaaaaaattgtttgttgtttatctgaattcaaatttaactgggtatcttgtattttatctgccaaccctaaccactgaatatattaaccctcataattaggaagatttcagaaattctgtaagaggagattgctttaaaactatgattgaatgcgactgaaattaaattagaaaatcgaataaattctggagagaaggagggagttttatgtaagtatttaagtggcaaattagaattttttaacatgaagaataaaatacagaaggaagaattgaaagagagttggtgggattaaaatgaattgttaagataaaaacctggagaaataatgatatttaaatgtgaaaattaaaaggaaattaactatgtttaaagaaaatgagaagtctatgaaagtagagtcgaactttgaattaaattgtgatatttccaaagtcgagtttgtaagacaaagagcaacattgtcaacaaggaagtttgtaaattttaagttcatgttctttgcaagatgagtagcatatcaaaaattaaatgatgaatattatttgctattcttttaaatttgcatattttccattggaaccagataaactatttaagccaacttttttttgtctgaaatctgagtattttggttacagtgtttatataaacaaatgagggattagagtagaataattgtgttgctgttttcacaggttagagaatacttttcatcattctgaatgtagttcaattgtaggtaaggataacagctttcagaagtgataggataagtcataacttgatttaatcatcttctatagtggaatttaattggggtggaaatgttacattttaagacaaattattcactaaatataaaagctctgtgttagtgtctattaaattagaaagacttttacagaatatatatacattaacattaatgaaaattaacatgtattcatgaggatagcaaacttttgaaaacactacgtgcttgtttcttgggatatatcattggatataacaaatgcccgtgtctttgtaaagttagggaggaaaggctggcaatgacaaaaaaaaaaacactattaccaaagtaaattatagacatgaacatatatacatatagagacagatgggatggatggatggatagatatagatagatagtaggagtaggtaaatcaggagtgccaaagaagagggagttgcaattataaatgtaatagttaaggtaggcttcataacaaaggtgagaactgagcaaaaacttgaaggagatcagaggattgcagttatttgtaggcgcagaaaagagccagatcaaagacttaagataggaactccttgaggtgtttgaggagcaacaaccaggcccatgcaatttgcatggaatatatgagagggatacattaaattagagtgataacagaggagagagacagatcatgtaggatgttgtagatcttttgggagtcatgggagggttttgagcatgtgttgatccatattttaaaagtgttaccatggcggtttattgatgatatactggggattaggaggaagattagaaacgggatttgagttaagatgaaattatcaagggaatgcattctagatagagaaaaggaccgggaactgagcctgaggcaccatatcactaagaggttgtggggaacaggggaagccatcaaaggagactgaaaaagaatgactggtgagataggaaaacctggagtacagtatcttcaaaggcaagaaaaggcattatgtgaggattaaggagtaattaataatgtcaaatgctgacgattatccaggtcaaggaaaatgaagactgaaaactggtcatggatttagcatgaggaaattgaccataacaaaagcagttttagtggaggggaggggttaaaagcgtgtctagagttagtttaagagagaatggaaagtggggtggggatgggggtaataaagaaatgggggagtagcttaagggacagtgtggtcaaggggtttttcttttattattaatggtttataacaccatgtttgtgtgctgatggcaaagatctagtaagacaaaatatggtgatgtaggaaagagatctcgtgtgcaaggaagaagaatcacttgttattcttcggcttatcaaactgcagaataggggctcagggcctggaaactaagaattttttcttagcgtttttagtttttgctttttttcttttatttgattattttattttttcttttatttcttttattttttcttttattttcttgttttattttatttgcttttttcttttatttctttttatctgtcacccaggctggagtgcagtggcgtgatcatggctcactgcagccttgagcttctgggcccaggcgatccttccacctcagcctcctgagtagctgggattataggcatgcaccactatgcctggctaatttttaaatttttttgtagaggcggggtctccctatattgccctggctagtctcttaactccagtgctcaagtgatcctcccacctcggcttctcaaagtgctgggatttcaggtgtgagctaccgtgcctggcctggattttgtacttttaatgggctgtaaaaaaatgaagaatatgtgagaccattgtggcccacaaagcctaaaatatttactgtctggccctttacagaaatagtttgtacagccctaatttatgataacttggaaagcagtgtgttggctgcagatactggtagatgggtggactagtggtgtgaatctgtggaagttatgttctgattatgtttcctcgtttgtatcatacacatttatcttacaattccaaggtaggaaataagttaaacaatgctgcaatcaaatttggtaacccttacctttcttgtgaaggggcacttgggcacttcctttcctttcctaattcattggaggaagaaagagaagttgggaagataacaattgatagcaagcttcttaaaacaggctcctgtttcttggctggatgcttccttttgtatattttagcaaatggaggaaatttgagcatagagtataagcatttgggatttataatttgggacttcagttttcatatgtattacaccagtagaaaaaaatacgaattttcttttcatgttacataatccaacagtgacttatttttatagaagcttctctactgccaaattcattttatacagtcttaaaaaattatcagtaaacaagctatatttgtgcataggaaataaatgcttattggttaatttatataatgctaagataagtgtgtgggtatgtaaagtagcacagtcattatggtaaacagtgcggaggttcctcaaactgaaaatagaattactatatgatccagcaaacccactgctagatatgtagccaaaagaaagtaaatcagtatatcaaagcgatatctgcactctcagatttattgcagcactatttacaatagccataatatggactcaacatgtgtccatcaactgataaattgataaagaaaatgtggtatatatacacaatggagtattgtttagtccccctaaaatgaaatcatgtcatttgcagcaatatggatggaacaggaagtcattataagtgaaataaaccaggcacagagagacaaatattgcatgtcttcactcaaatgtcagagctataaaagttgatttcatataggtggagagtagaatggtggctaccacagcatgagaagagaagcagggagaaggggacaaagagaagttggttaatgagtgccaaaaagcaattagatagaaggaataagttgtagtatttgatagtaaagtagggaaattatagttaacaatttattgtatatttcaaaatagctagaagagaagaaatgttatgctcccaacacaaagaagagataagtgtttgaggtaatagatattctaattaccttgatttgatcattacacattctatacatatatcaaaataccatgtgtataccatatatgtacaacttaaatatcaataaaaaacttataagtatcaggccaactaaaaaaaaggaataaaaataaatacctaaaacaaaatggagagaattttcatctgtttccaagaaggaaacctggcttaaaaaaaaattaaaaaatacagtcaaatcactattgtttagcttaatcaattgatggaaattattaaaggcaattggacaattaattccagtaataaatatcctaatcaagttaatgtatattatacattcaggagactgaatcctaatttagtgtaggtatatcttgaatgagtctttattagaaatttctaatatggcacatgaaattatgagtttattagttgtaactctttttgaatttaatgaatacttggacacaagtgaataaaaagcacgtgaaaattaaaaaaacaaaaatgaatcttagcttatgaagttattttcttttcttgcttttagttacaatttagaaagcagtatatggaatgtaggaactccatcaaggggacctctccagagatatggacactctcttgctttatatcaggtatggctcctgctttttaaattttaatcagattttgtttttgatagtttaccacaggctaaaaaatactaaatctcagatttatttcaaatatttaatgagaacaatagattatatggatcatgataacttgagataccacatactcttatgcttttagtaaaagaatagattttagaacaatcccccacatgacatgtaaagaaatgaagattgagtttttgtctatttatgcctagtcaatcacttaaaaaaattatggcgaaatacatgtaacataaaatttaccattttaactatttttaagtatagagttcagtggcattaagtacattgacattgctgtgtaaccatggctaccattatcttcagaacatttttcatcgggcaaaactgaagcaataacttctcattcccctcttcccttatcctcttgaaaccaccaatctacttttctgtctctgtgaatttaactgctctaggtacctcatgtaaatgggattgtacattatttgtccttttatgactgatttgtgtcccttagcacactatcttcaaggatcatccatgttgtatcatgtgtcagaatgtccttccttttgaagctgagtaaatattccattatatgtatataccacattttgtttatccatccatctgttgatggacacttagatagcttccatcttttggccattgtgaataatgtttctatgaacatgtgtgtacaactatctgagtctctgttttcatttttttttggtgtatacccagaagtggaattgctaaatcgtatggtaattctatgtttaattttttttttttttagcactgccatagtgttttccactatggctgcaccattttacatttccaccagcagtgcacaagggttccagtttgtccacagccttgtcaacacttgttattttctgtttttgtttttttgataattgacctaatgagtatctcactgtgattttgatttgcatttctctaatgattaatgatgttaaatatcttttcaagtgcttattggctatttgtatatcctctttggagaaatgtctattcaggtctttagccagttttgaattgggttgttttgtttggttgttgagttggaggagctctttatatattatggtattaacaccttatcagaatatgatttccagatattttccccctttatgggctgtcttttcactttgttgagagtgtcctttgatgcacagaatttttaattttagtttaatttaattttaattttaatttattttttcttttgttacttatgcttttgtgtcatatgcaagaaatcattgctagatccaatgtcatgaagcttttcctctatattttctcataagagttttaaagttttagttcttaggtttaagtttttgttgcattttgagttaattgtgtctgatgtaagggtccattttcattcctttgcacgtggatagccagtttccccaacatcgtttgttaaaaaagaaactgtctttttcccattaaatggtcttggcaccctagctgaaagtcctttgaccatgtatatgagggtttttttttctggactctctattttattctattgatctatatgtctgtctttatgctagtaccgtactatttagattactgtagctttttaataagttttgaagttaagaagtgtgatacttcctactttgtttttatttctcaagattgttttggctattcagggtcccttgaaagtctatatgaattttaggattaagtcttctatttctgcaaaaatgttggggttttgacagggattgtattgacattagttatttttatgtatttgtgggattcataaatttagcatgattaaaatgacaggacacttgtttggttttcattttgaatcaacaaaatttcatgtattttgtggcctttggctaggctgtctaaatatgaatttatatgttttctgtgctgttgttaaaaaaaattggaaagcatgggagcagtataaagaacaaactaccacctgtttatccatgcatttgtgtgttttaaaagtaaaataaaagtatttctatgtatgaaaacatatacctacattttttgccttgttttattttttctttatttccctttttgtaacagccttactgagatataattgatataccatacatttcactcatttaaagtgtacaattcagtggtttttagtatattcagagttgtgcaaccatctattgcagatttatgtaagattacagagttgtgtaatcacttttagaatactttcattacttcacaaagaaactttgtatcctttcggtatcaccccacacttcctcgtcttccctagccttaagcagtcacaaagctactttctttctctatatattggtccatgctggacatttcatataaatgaagtcatatactatgtatgttatgactaccatatttcacttagcataatttcaaggtttatccatgttgtagaatgtatcagtacttcttcattcctttttatggctaaataatattacattttatggaaatataccgtgttgtttattcatcggttgaggacatttgagttgtttccaccttttggctattatgaataatgctactaacaacattgctgtttaagattttgtctggacatatgttttcatttcttttgggtatatacataggggtggacttactgggtcaaattcactttttgaagaactgacagaatgttttccaaagttgctgcatcattttacattcccaccagccatgtatgagggtttctatttctatacatccttgccaacacttattagtatctgcctttttgattattgccatcctagtgggttgaagtattatctcattgtggttttgatttgtatttccctgttaactaatgatgttgagcatctttttgtgtgcttttggccatttgtatattgtctttggagaaatgtctattcaagtcctttgcttattttaaaattaagttgtccttttattattgagttgtaagaattcttcatatgttctagatacaagccattatcaggtaaataatttgcaaatattttcacccatttcgtgtgctgttttcactttcttgatgttatctttttaaacacaaaaaattggactttatcttgataaagtccaatttaactttttttccttttattgcttgtgatttggtgtcatatttaataattcattgccaaatctcaggtcataaagacttaacccaattttttttttcttttaagagttttatagttttgattcttgcatttagttctttgacctattttgagttaagttttgtatatagtatgcagtaagggtgcaagttctttttttttttttttgcatgtgactatccagttctcctagcaccatttgttcacaagacattttcttttgtctttgaatggtcttggtactcttgtcaaaaatcaattggccatagatgtgtgggtttatttctggactctcagttctattccattgatttatcccagtatcactctgttttgattacttttttttttttttttttgagacagagtcttgctctgtcacccaggctggagtgcagtagtgtaatcttggctcactgcaacctccacttcctgggttcaagcgattgtcctgcctcagcctcctgagtagctgggattacaggcgcctgccaccatgcccagctaatttttttatagttttagtagagatggggtttcaccatgttggccaggctggttttgaactcctgacctcaagtgatccactcgcctcggactttcaaagtgctgggattacagtcatgagccaccatgcccaacctatcttgattacttttgctttgcagtaagtttttgagaagtgggagtactccagttttgttcttttacaagattgttctgatgttctgcatcccttgcaatttcatatgaattttggaatcaatttgtcagtttctacaaagaagccagctgagattttgatagggatcatgttgaatctgtagatcaatttggagagtattatcctcttaatcaatttggagagtattatcttaacaatgttaagtcttcagacccataaacatgggatgtcttttcatttatttatatcttttaaaaatttatttaaacaatgttttgtaattttcagagtataaggtttggacttcctttattaaatttattcataagtattttattcttttagatgcttttgtcaatgtaattattttcccaatttcatttttggggtgttcattacaagtgtatggaaatacaatttactttttgtacattgatcttatgttctgtaatattgctgattcatttattagctctaagtgctttttaaaaaaatttttaggactttctatataccagattgcatcatctgcaaatagaaatattttacttcttctttccaatctggatgtctttatttagtttttgctctagctggaacatccactacaatgttgaatataagtggcaaaagcaggcatgcttatcttgttcctgaccttagggaaatgtatctagtctttcactgttaggtataatgttagctgtgagtttccttaaatatcttttgtcaggttggaaaaatttttttctatttctagtttgttgaaataatgataatttacatcatttatgtaccatttatttccatcatatgcatttgaaataatttgtataatttaaaagttctacaaggatttaccaaaggtgaactgaaggcatgtggtgtctgtctatagccattagaaatggtaacagaggtgtactctacatgatgcacaaatgtgatatgtctttttggtgaagagcacgtgatgaaaacagtaaataactgagaatagcacaaagctactagggactcagatgattcaaatattgaagactatgagtaatattaatcaacaacttagtttgttatcttcagttatatgggaggagtacattattctttgttataggactacctcacccttaaattgtaagttctttattagcttattgcattttccattcttaaagcagtagtttagtgttctcttactgtatgacaattaaaagtatacttaattgactacataatgtgatagttaaaaaatatatttaaagtagctttttgaaagctttgctgtttccccccctttttgtatataaaagcattagttgtcattattcatgtgttctcattactttttacaaatgagaacaatgccttatgcatgttgtgaacaattactaaaattttatgtaaatttaacctttatttttaattaatatgtgttaagatataacattattttatctattaatatatgtattttaatttacaggaaaacatctttatgtatggaggcagaattgaaacaaatgatggcaatgtcacagatgaattatgggtttttaacatacatagtcagtcatggagtacaaaaactcctactgttcttggacatggtcagcagtatgctgtggagggacattcagcacatattatggagttggatagtagagatgttgtcatgatcataatatttggatattctgcaatatatggttatacaagcagcatacaggaataccatatctgtgagttacttaaaaattgtaatttctttattgattgggaatgtttttctctaataaaatcttcatatgaatttagtcaaaatggtgagttatttgagattgaaattataagctgataattaataatttttaatataagcttttttgattatgttagattttgtcctttaatatttaagcttacctttttaaccaaatgaggggaaatattacttaatagtctcattttctaagatttgtgaattttttaaaaaaatatgtgaaattccagtaggtggtgctatttctttggattttatttatgaacgaagtactgaaactatcccagtctctttactatgcattgcatggtttcaggattttttattttttagcattctatttctaatcttactgctatatctttatgtatgtattacttctttaaagtcagcttctcaaggatagtctgctggcttctataagagattattatctgttatgtgaaggtgaaggtgtctagggcaatctacatgtgagtttttgtactatacctttactccattttgtttttctggtacttcatttttttgaattatttataacatttttaaaacagtggtaaccttctttattgtttttagtttgtttacaaatatatgccctatggtggttattcagattcaagaaaataattcttttctggctctggccagtatgatgaactcaaattcttggctcttttgtgtatggacaactatatatacaactatttagagtccttgtgcagtcttaatgagaaaactcatttgcagaccaccattagcaagagagtacttgtatgctcagaggaagactccccttcgaaatactccactgtttcccttgcagtcctttcaagtgatggctgtttttgtttacatattctcagtacagctgggtcaaaagtgggttacatatcccctttacttcttattgccatttccactctattctcaattcctcctcctttaaattgcctggctttgactcttacatcatcagaatatatcacctattacttcaccttcctgcactcatcctttgctctcagatggctgtgttttatttcttgaggaatttagcttctggcttactgtcactgtgtccagaatacataaggcaaatatttttatgttgtaaatatgcacttaagtacttctcctacctggcctgtcaatttcttgatctaccaaagattttgttttccatcctccttgagccactctctccattgttacgttctagaccttgttattccagtacaatgagtccataatttccatatgaaatatcttacttttcaagtcccactgatctctccagcttactgtttctaatgcccacactctgacaattctttgaccttaccagagcctttagtctgttgagactatcagtttttccactatctctcactctttttttgtccatatttctaaccctacctttttaatccatacttctagccctacccatacttctaaacgtacctagctttaaatttcataattactgttctcaagttgtttttttttttttatgatatccggtacttactcagctgtaagtttataattactcatgtcaagttggcccttaatgacatctggaacttctgccagtgtagcttggtctcgctcccagctctcctggatgactatttcataccttttcctctctcctcaagtttcaaacacttccttctctatcatcactcgcaattgatgaccttagttcttattttactgagaaaacagaagtaatcaggagagaatggctattgatgagaacacgttggagggtgatggttaataagcaatgctacattgaataagcttgcttacatacattattgtcataacaaactcatgacaacgttgaggcagatgtgtggctgagttattccaacttttgaaatgggcccaggagtttttaagcaagagttaacagatgttctatgtagaagggcagttttcttttctgattttgttattaatttttggttttattatagtgctcaggaaatgttggtcttatttctactttttaaatttattgaaattttctttgtgcctcagttttcacaaatatttgataggcacttgagaagaagataaatccaataatatcaaggtatggagtttgatattatttatttataaaatcgactttattgattatattgtttaggccttctgtactgacttagtattttttgttcttgatttatcttgctgtgaaagtggaagtaaaattttaaagtgttagtgtatttttcatatttctccttatatattctggaatttatgttttatagaagttgctattacaaatattaataattgttatgtgcttattgtaaattgtattacttactattataaagtggtttgtttaatgttttcttgacctgaattctacctcatctgtcgttaatattgcccttgttttgtttttttggtcagtcttttcctagtatacctttgctcatccctttattgttattattgtttagtgttttagaatcactttaaaaaaatgtatttcttgcatacgagagagttgaattttgctttgtgattcctgttttttttttgtaaattttctgtacatgtcttgtattttcaaaagtcattcttgcttttttgttgatttgtttttaattatagctcttctcacgtttagggccctccttccccttaactttattttatttttttgtggggatgggtgtggtaagttttgagatctgcttccattagtttcctctatgctacttgtttctcattgccctttcagcatttttgtggctgcttctgtttagctgttttggtttcacttgatttttgtacgttcatacctaatctagactttatgaggaattttttttttaccctcataatttctctggaaatgtaattttcttttcctttcacttcatctactttccccatgttttccttttgttttctatttcttttccagggagaatgggggagattcagaactaaactgttaccacatttgtccttgaaacacaggttttgacttttgaaattttaaaatgagtacttaacttagtctaaagttaagcaatactcttattctttgatcaacctccaatttataggatactgttttccactgttttagttatttttgttttgtttcaaacacaatgataattatatcattttataatataaataaattaaaaataaacagtaagtatatcatttatttacaggggtcagcaaaaggcatctataaatgaccagatagtaaatatcttaggctttgttggtcatacagtctctgtcacaactaattaactctgccttgtagcctgaaagttgccatagacaatagataaacaaatgggcatggttgtgttcaataaaaatttatttacaaaaacaggtggtgggctagatttagcctttgggccttactttgcctacacttgctcttaagagaaagagtatgcttctagggccctagtaaccctgatccaacttaaattaaaatttggcatatagtttttttttggacattatatatagggaaaattcatgccccaaagtagcctgatatctagtaaatggcccaaagttcccagggggaatagttgtttcgtatatgtggaaccaaggctgaaatagatgctatctatctgcctccacggagcatatttttaaaaactcactttttcattgaggatgtacactttcaatgatcttgactttacatagatactctctaatcttatacctacatgggtccaccttcaatgttggccattaaaatggaatctctaggccacctgattagtatatgtcatccttactgaatatagtttataattcacagttggcagaatatatttcgtgtgcttcatcgtttcctttattgaacgtttgtcccactcagccatcagacataatggtggttatgctttccaaggatggctaggaaagtactatgggtttattctgatcaactattagtgataaatattgatataggttgttagctgatatattaatctcctggtaggtttttgtttgatttgggataatctgattacagaatgccaattttgttttagataatctaaacatatttttatattgagtttcttttggcttattctacaaccaaaatactatgtctaaataaatttatctgcagggtatttttggcttgatttttgtcttactaactgcattacttgtcaggcatacttaagaatgtagtgtaagatgaaaatgggaagaatacatgattgatgagttttataagaataatagataaaccatgggcagtttcacattctgtgaattattgaagtacaaagcaaaacccaacaaattttttataaaattatttcttaatagaaaaattaatatcttactttacttattcctaaggcattttgaatttgctgcttacatgttgaaagtatgtggtgtcataaaataatctatagtactttcaaagaaaagagtacaaaatgatgggtaaatgtagtttaaagatgctgtcagaataattaaattcaccacactgtcttccacagtggttgaactagtttacattcccaccaacagtgtaaaagtgttcctgtttctccacatcctctccagcacctgttgtttcctgactttttaatgatcgccattctaactggtgtgagatggtatctcattgtggttttgatttgcatttctctgatggccagtgatgatgagcatttcttcatgtgtttgttggctgcataaatgtcttcttttgagaagtgtctgttcatatccttcacccactttttgatggggttgtttttttcttgtaaatttgtttgagttctttgtagattctggatattagccctttgccagatgagtagattgcaaaaattttcttccattctgtaggttgcctttcactctgatggtagtttcttttgctgtgcagaagctctttagtttaattagatcccatttgtcaattttggcttttgttgccattggtttagtgttttagacatgaagtccttgcccatgcctatgtcctgtgaattgttttggctgcatgttgtaaataaactttatggaagaaagaacagaaagaggatagttaggaagttgttaacggtaatctgggccaaaaatgatgatgagaattagtcgatctgttggattttttaaaaaagtagagccaatagtatttgctgagggtttagatgtagagtgtgagataaaagagaggaaccaagggtgattccaaaattttgggcctgagcagctggaaagatgaaattgccatcaaccgacatgtagtagattgtgaagcaggtttggggcaaaggtgttttaacgatgaggagttcagtttggacatgttatacgtgagatagccactagatgtcaaagagaaaatgtcaagcagacagttggatatatatgttgctataggtactcttttttttaaaaaatttatattctttttctaagaagttttagagcaggaattctgcagtatacctccttatgtgtacactttctagtaaagtgccatattcttactggagtcctagagagaaagatctgggctgaaggtgtaaatttgggagttcttgggagttcttaaagccaagagactagatcagatcactaatgaagtgggtgtagataaaaaggagaataaaaggattgagctatagggtccccgaataataagaggtaggggagaaaaggaagataagcaaggaagagtacggtgaagtgtaagccaagtgcagaaagaatattaagtgggaaagtaatcaacggagccacattctgctgatgcctcaagtacaatcattactaaggattgatcattgaatttagcactgtgcagtcattggtgatcttgataggaacagtttctgtgtagtgatggggtgaaagtctcacaatattggatttaatagggaatgagagaagtagaagtggaaatgatgggtggaaccagctctttcaaggaaatgtgtttgaaaaggaaagcacaaagtgagcagaaactggcaagaaacttaggatcctttttagcttggatttttacagaagcagacaatgagacaggatttcagtgaaataattctatttgggaaagtgtaggtaacactgttaggggagttgatacaaggacgagaaggcagccatttaaaggtccaggctttaattgacacataatctctgaaattttctttaactattaaccctgtcagttgtcagttgatgtgtcccatggactatgtctccaaaacctacccattcttagtagagaacctatccatttttgctagagatggggtttcgccatgcctgtctcgcactcctgacctcaagagatctgcctgttttgacgtcccaaagttctgggattacaaagtactgtgtcatccagtgtggcttgattaatatgaaaatgtttatagagataagacaacagaatacttaagaaaatagctagtgtgaagcatacacaaataaatcaggaagggagctgtgttttttttttttttttggttttgtttttttgttttttttgtttttttttttgtttttttttttttgagacagtctgactctgttgcaggggctggaatgcagtggcacgatctcagctcactgaagcctctgccacctgggttcaagtgatcctcccacctcagcctcccaagtggttgggattataggcatgcaccaccacacccagctactttttgtatttttagtagagatggggtttcgccatgcctgtcttgaactcctgagctcgagtgatctgccttcttcgacctcccaaagtgctgggactacagacatgagccaccgtgcctggccaaggacgggaaattttttgtgagaacatcctagagtacaacttctaaaagtgatgtcgggttatcaagtgcttaggtgtgacagtgacaacaagacttatattcaaaattgttggaaaaatccagaaaatgtttaatgaagaaatcagcttgcagtaaaggttccacatgcttttgtttgtcacagagtggaagtggccttcataattgtataatgatgaaaagacttcttaatccacagctttatttactgcatttttcattttctggaagtagttttattttcctctaagctcctgtgtccttttgtttttaaatgaatatgacacatgctacaatttgaatatgtcccctccaaaattcatgttgaaacctaatccccattgcggtagtattaagaggtggggctttttggtgtgtgattaagtcaggatggctctgctgtcatgagtggattagtgccttacaaaaagtgctggagggagctagctgggtcctttttgccttccatccttccaccatgtgaggacacagcattcttcccctctggaggacatagcaaacaaggcaccatctggaagcagagcgtagctctcagcagacaccaaagctgccagcaccttgattttgaaattcctagtttccagaactgttagaaataaatttccattgtttattaattacatatatgctgttttttataggtactctttttttttctaaaaaaatttatattctttttctaagaagttttagaggaggaattctgcaacatatctcctgtgtgtatactttctagtaaaggggcatatattaaatgcttgataaatatttgtggatgaataaatacgattttcatcacactttccttaaaagtgtgaatctgtttcttgactttgtttttagtatattaaccaaattatttaaattgtgtactatacgtaattattattctccttctagtggtgactcataacatgctgtgcttgatgtcctctatttgtctctccacatctaccttttatttttttccatcctgtttccatgccctctggcttccaggtaggctgagccagtggtggtagatctgatggtgggagatgagtggggttgtggtattttattccaccaactttctccctgctggataaccttgggttagttgtgttgctttattgaaggctgaactgtcaggtgtcctcatatagctattttctaggaattctggaaacactccctcctcttgcttttttaaggccaaggggtggtaaagtcttcctgttgtggtaggtctcaggatattgccctggtcatacctttataaatagcctttattagatactttataattgttttgatcatattatttatttcctgtcagcaccctggctgatatagtagctactattggctttttagagattcaaatataacttttgaccaaaatgatccttcatatgttcttattctggaagttgagaggaagaagtgtcttgtgggaggatttcacactttattagtggataaaaatgttggcagaagtataaacatttcagaatagcatggaattaggtccttcagtccatttctatgcttatttttgaatttttaaattttaatgtcacatggtcatctttaatgttgcattttctcttaatgtgaaagattaatatatttatcatctttcaagagtagctgttccagttttttaataagcagaacccttatttatgtatttcttcttatttattcaagaaaacctttttgttggatattcttttaaatttctttttgaattatgctaactcagactcaacttttttttggttattatgctatcaacgtagaagtaatcattgtcttactagcaaaatacctccaaagtgtatttgatgggaggatatttatttttttaaaagcccatttgctgtattcctttaagttttctctttaaaatcatgttaatttaaaaaaattgttgatttttttcaacttctccattattctgaaatccagaaattcttattgtatatttgtttttaaaaatagctttatcacatatacatgtgcatgtcatctggtttgcttatttttgacctttataaaaaggttgtatttatgccattttctcaggctttctttgattttgtttatcacgattattaccaagattcatccatgtcattatatattgctgcagttaacttctttatatttctgtattttatttgttgtataactctaccacaatttatttacctatttccctgcttttgagcttttggatttggtatctagtaaaatttacccacagtagccattttgagacatatcctgataaactattgcattttaagagataaagaaaaaaatccttaggattttccagcagaaagatgaaatatcttacaagggcaagagattagactagtatcagatttttcaaaagcaacctacagatcaaggcaaccatggaacaaaattttcaagacacttcagaaagtatagaccaagggttttatgtcttgccaaattgtacctcaagtgtcaaggctatcaaaaataattttgaacatagaaaaactaagttaatactgtatgtgtgtgcccttacctgagaaatttatatactagggtagaggtttgcagatgttttttggtaagggttcagatagtaaatagtttaggctttgtatcctactaaattctgttgactctgttgtcactactcagttcttccattgaaactgtatacaaacagtataaattgcataaaagggtgaatgtggctatgtccaataaaacctgatttacaaaaacaattggtggagttaatgggctgtaattttccaatccctgtcctggagaatgagcttcacctaatgaacagataaatgggaacacttcaggtaaaagattgatggaaaacatttcccatacttaattttagagctaagactaaaataaaggtaggaatatgtgtagacaactaaatgtgcaaatgttacatgttttgtccaagtagaaataatgcagttaaaaatgggagaagggagaggaaaggggaaatcagagataagaacattgacagctgcatatgtaatagataggaatcaaaagatgccatttaacacttgatattccatcaaggtctattggacccaattttaatttttagtttgttttctgagcaggcctaactatttgcgaagactattattttatacattttattctttcttagaagtctttcaaagaacaaagagaacatttacttgttaaaaaaaatcagaataaaatattctgtctgtgattaccagatgggtctgttgcattcttttaaaaatgaaagatacactgtggaatttaaatgttgttattttctgtgttctaaagcattttgctatttatcattttaggaactaattcattacttatcaattatttccaactatgctaaaaattaacaataaaacagaagttttttagaaagatgatgccacagtgaaaaaaactgtcatcctttagttgtattattgcggtgcccgaagtattttattacctttaaagaaggcatacaagaagacaaagtaccatcattgtagtccgcttttagtttttgttgaacacagttgagaatttaaaatttttcattttctgcccatactagtaaaaagttgaaagatctttcgcagtaattagacaaataagaagatgaatgcaaagagacagataagaatgcaaagagacagatggtaaccctgtaaactctggtgagtttacactaaatctcagactatggatcttcaggaaatgatatcctaaatgaattttttcaaactcttagattcagtgagtgaacaatacatttttattttttattatgtttatatgccccaacactttaaaacaaagaggtttgctatatttaaattctttttggaatttgcaaaaggtagtttttgactgacacttttttcttgtgtaaattacttatgatgtgataaagcaactaaaaggaactattgaatcatgataaatgctgattactattgttctaggtatactgaggattaaaactgacagaacagataataaaattaggtaagaaagatgagaattaagggcactatgaaagatacatacacaaaggaaaacactaacaaagatataaacgttcttacctaccaaaagaaataaaagcaaagaaatatcaaataggaaaaaactcagaaatatgcattataatacatacacacagtaattatgacataaaattctgtgacagagttgagattcaccataatatcagtacatgggaatgggattaacttgtttattaaaagaaaacatttcaacttgctgcataaaacaaaacccaaatctatgcttgatttaggagacatttacaacatattgatgcagaaacgatgaaaataaaggaacagagaaagatttcataggtgaatgattacagtaagacagggaatatcaaaacattatacaagaataccttataattactaaaacccacaattcaccacaatgatatgatatatattagaagaatattatctatacaccagacaacccagcaaccacctatagaaaacagaaaccacaggcagtgaagagaaacagtgtcacttcagtacaaaacaggtcagtcattattgtcaatacacgataggataaaaaataagaaaatatctaaaaaaatctaaacaacataactaataaagttgaagttaaggatgtatagcgaacaatacagcccgattatagagaatgttgtcttctcaaatgcacatggaaaacccacaaaaattgactgaatatatatataaaaaattagtagtttcccaagaatggaagcattgaaaataaacacctgaatattaaataaaatctttctattgggtgaatggggaaatacaaggaaaaattacagaatttctgaaaaatagtgacagtaaaagcaacacatataaagatttatgggatacatttagagcagttatcagaagtatatttataacattaaacaactctattaatatgaatgaaaataaatgcaccacattcccaattcaaaaagctagaaaaagaatagctaaaccaacaagtaaagatttttgcataactttttatataactaggaggagaataaaaataaaagctgaaattaatgatgtaagaacagaaaaacagattaatttttttgaaaaaaacagagaagccagcagctcatttaatcaagaaacaagagagcaagcacaaatacacaaaacaagaaatgacaagggagaaataatattgataggatattaaaatagtagactatcttgtacaacaatgcaattaaatttgaaaatgttgaagaaatgaattatttcatagaaagtagcaatttttcaaattgaacccagtaaatataaaaaatttgtataaagcactttccttagaaaaagtggagaaagcaccaggcctagatgataccagagagtaaatttagcaaaatcttaatagctggatagtctcaatgctatgtaggttgttttagagaatgataaaggaaggaaacttccaaatttgttttataagggaagtataacattgccacttaaacccactacacagaaatggaaaatttacatatgtatatgattaaaaatgaaataaaacctttccccgttaaatatcaacacaaaattctaaataaaatgaacactccaacacattcttttcttaatgtgtgttgagttttattaatatattttataataagcatccttggatgcctgggtatacatcccatttaataataaaatacacattaatagataattaagtataattaagtgggatatatagccaagcatctaaggatgactattatgaaatatattaataaaactcactatattagtaggtcaaaggagaaaaatgatattattttcattggtattaaaaaaatcacatttctaataacgcttgagaaaatgggaatggatggctactgtatgaacataataaatatgtttcaatcccaaagccagcatcttatacttaataagggaaataagcatttctattcacttcaagaacaaaacaagcgtgcacactatctccagtgcaagattatatatatatatacacacacataaacacacacacaactatgtatataactatatatacacaactatgtataactatatatatatatacacacaactatataactatgaagtagtaatatatatacatgtactactttttgtgtaagggaagtaaaatatagttacacatgctaatttgagcaaaaatgaacacaggaaagataaaccagaaaacaagtatgttggttatttacaaggggtggtagagaatggtatggtaaagatatgacatgaaagtatatttacctgtgtttactcttttaaaaaaatagtcttgacttagaaacattgatttttagaatcatattaatcatttacatattgaacaattaaataaaaaaggaaaggaagaaaaaaatcataaaacaatgtaagctgaaacaaatgaacccaactatgtttcaaatgaataggataatcattctgaaacgggatgaaaagaactaatgcaagtgatttttgaacacagtatttgactatgtgctctcagtcgaggtttagatgcgaagaaggactgcaaacaaatctttgaggtttgttttttgaaggtttaggtgaagcaattctgaaattattttagatatatgtttagactaaaaaataagtaaatatatttttttgggaaccaaagttcttcatgtggaagacgagaactgcagctatgaaatggggaagtcaaggaagaatcctggcctggatggattgcaattggaggtatcagtatgagtttatggttacttagataaatagatacatggatatgtagatacataaataaataagttaatacatagatgtagattcttctgaaagggcccagaagctaagacaccccagtagtagtgagcacactgagcactcgtattcccagatctggtttgtaatatttcctatggaaagaaagcagggctccttggaggagctgattctatgactgtgacaaggaaagtaaagataagccaagtacatcttgttatatcaaattaaggaagcactcaagaaaacgatgggtcatgtcaaaagaacacaggaatcaccttctaggggatcccattggtaaaacatgggacaatttgagcattaaaataatttaagaaagaaatacattaaaaactattgaaaaaataggaatgcataagcttacactgagagtagacagacaggtacaaatacagaagaagggaagcctctacataggatgcagactgtcatagctggagttgaaaaatcattttgcaaaagtcatagtaaaagttgggatgggaaagaatcatcaatggatgttaaatctgtgggggtgggtatgaaatttttttatgagatatgcacggcatttaagtctcccctacagattgctgataaggtgcgggagaaaaatcgtaactacatagtagagaaacctgtcaataacttgtctgagtgatcaaaattaacatcacaaactaaggggaattggacactgtgtgcctttgtatataatacctacagaaagagacattacgtgtggtagagttctgcaaaccagttctgtaaaagttgaaatagtaaatattttgggctttgtggactatacagtctctgtctcatctattcagttttgccaattctgccattatagggtgaaagcaagccatagataagtaactgagtgaacagaatgaagagacattttatggaaagggggaaaatattcacaaattatacatctgataagagattaatatccaaaatgtataaacaacaacttaaaacaacccgattaaaaaatgggcaaaggatctaagtagacatttctcaaagaagacatacaaatgataagaaacactggcgaggatgtggagaaaagggagccctcatacattattggtgggaatgtaaattagtacaaccatgatggagaacagttcggaggttcctcaaaaaaactaaaaatagagttaccaaatgacccagcaatcacattgctagatacatacccaaaagaaagaagatcattatagcgaagagatatctacactcccatgtttgttgcagtactattcatcatagccaagatttggaagcaatctaagtgtccatcaacaggaatggataaagaaaaaatggtccatatatacaatggagtaccattcagccataaaaaagaatgcaaccctgtcatttgcaccattgatggaactggaaatcattaagtgaaataagccaggcacagaaagaaaactgcatgttctcacttatttgtgggagctaaaaataaaaacaaactcatggagatagaaaaatgatggttactagaggctgggaagggtcgttggtggggatgtgaggatgattaatgggtgcagaaagtatatatacaatgagtaaaatcctctatttgacagcacaacagtgactatagtgaacaacagtttattttacattttaaaataatacagtagaattggattatttgtgtcaaagaaatgaatagatgtttgatgtgattattatgcattgtgtgcttgtttcaaaatatctcatgtaacccataaatatatacatctatgtgaccacaaaaattaaaaataaaaaaatttataaagcaaaacataaaaatggccaacagatgtatgaaaacatgctcaatattactagtcatcagggaaatgcaaattaaaactacaatgatctatgatctctcccctcacacctgttagaatggctgtaaaaaagacaaaagataacaagtattggtgaggatgtggaaaagagggagtacttgtacactgtttctgggaatatttttttttttttttaacaaaaatgagcagcagagtaggtatgaccccacaggacatagcttacccacccctaccttacagtattgtgactagaaatgcctaacctgaagctaatcatgaagcaatatcagacaaacttcaaataaagaatatgccatctaaaaagagggatggatagctttattcttcaaaaatatccatgttatgggagacagagaaaggttgaaaaattgttccagattaaaggaagcttacaagacatgacagctggttgttgaccactggtgcacaacatggtgacaacaaatgcatgagaactggtgatcccagactggattctatgctggatgaaaaattaaaaaatgctatgaaggacattatgtactcagttcacaaaatttaaatgtatagatacattaaagtattgtacaaatgttaaatttcttaaagttgataattgcaatatggttatgtataatagaaagagggtgcttggttttttttttttttttttttcttttttctttttttttttgagatggagtctccctctgtagcccaggctggagtgatctcggctcactgcaacctccacttcccgggttcaagtgattctcctgcctcagcctcctgagtagctgggactacaggtgcgcgccagcatgcctggttaattttttaatttttagtagagatggggtttcaccatgttaaccaggatggtcttgatctcctgatctcatgatccacccacctcggtctcccaaagtgctgggattataggcgtgagccaccgcacccagctggttcttaagaaatacacaccaaagtattaaggacagtaagaatgatgtatacaactgggagagagggagggggagggggagggggagagggagaaagggggagggagaaagggagaggaagggagagagagagggagaaagaattaatgataaacgggaaaaatattgacaattagggaatctgaatgacaggtatatgtgtatggggagttctttggctattgcacttttgaaattatttgcaaataaatgtgaaaatagaagaagtagataaatgttttttcatatttggttatgtggaatatatgtttaactgaagattttaagaattcccttgaacttgctgtggcagtaaaggaaatgtcagtttgtccttttttgttatacttagaattacggcttttagggaatctacaaatctcagaggggaattatgtggatggttttactaacttggaccataaagctcttctgggttagtcctgtgggaaatttatttcactttagtttagcaatacctcataaactttctaagaatctcaatgtgagtctcaaggtgagtataatattaatgttttgctttagtatttttcatgctttaagaattttggaggtgtagttgggaagccataattaatgtcatttaatgttaacttttttccttttgatctaaaaatcattagattttttcagaaaggtatttttttaatataaatttattgatactatgagtttctcctctgctcttaatatcacatgtttttaaaaattctgtggtgaattttaagtgtaaattggacattgatttttagcacactggtgtctgaaaatagatccataaaacagatgtattaagtggtgggaattagggatttttaataggagaaatctccagtttagaaacaattcaatcataggaatcacagaaagcaaaattttattatgtgttgcaattaggcttggcatttgtggtagagtttcatttgtgcagacctttttaggaataattaagtaaaatgaaacagtatcaatataatgagtaaaatacagttatgccatgcacaatatttcaattaatcacagactgaatatatgatggaggtctcataagattattctggaactgaaaaattcctatccctggagatgatgtagctgtcaaaatgtcatagtgcaatgcattgctcatgtgtttgtggtgatgctggtgtaaacaaacctacttcactgccagtcgtacagaagtatggcacatacaattatatatagtacataatatttgatgctgataataaacaactatgttagtgatttatgtgtttactatactttttattattttagaatatactttttctacttacaagaaaaaaaaactgtaaaatagccttaggcaggaggtattccagaagaaggcattattatcataggagatgagagctccatgcatatgaatgcccctgaagaccttccagtgggacaagatgtggaggtggaagacagtgatactgatgatcctgactttgtgtaggcctaggctaatgtgtgtgtttgtgtttttgtttttagcaaaaaattttaaaaaataaaaagtgaaaaaataggaaaaagcttatataataaggatttaaggaaaaaatttttatagctgtaaaatatgtttgtgttttaggctgttattacagaaggatcaaaaagttaaaaaattaaaaagtttataagtaaaaatttatagtgggctaaggttaatttattattgaaggaagaaaaatattttaaaaaatttagtgttgactaagtatacagtgcttataaattctacagtagtatacagtaatgtcctaggccttcacattcactcaccacttacccactgactcatccagagcaacttccagtcctgcaagcttcattcatggtaagtgtcctatacaggtataccattttttattttttacaccacacttttaccataccttttctatatgtttagatacacaaataccgttgtgttctaattacctacagtattcagtacaacaacatgctgtacgggtttttcgttcaggagcaataggctgtgtcacacagcctaggtatgtagtaggctataccatttaggtttgtagaagtatactctatgatgttcacacagtgatgaaattgcctaacagtgcatttctcagaatgtatcctcattgttaaggaacacacgactttatcattttagcaaactgctttgccattgtgacaaatgctactgttaaaattgtatacgttttttttacttactaaatgtttttagttttgctaagtgaattattaaaccatatgcttttaagctatttaggaactacaaaaatattatacatatccttgaaaatttgcactgactatattaaaaagttttagtagatgtgcattcatattcagaaaattcttatttttctgtatctgcttaacattctttcactgatggatatatcagtgccttaaaaggcagccattctattactttatatattttaaacattttatttatttggaagaaatacgcactccctataatttgtacttataacattttttatttttgattattatgggcacataatagttgtatatgtttatgagatacatgtgatgttttgatacagtcatacaatgtgtaatgatcaaatcagggtaattgggacatccatcacttcaagcctttattattttttgtgttaggaacatttcagttctacttgtttagttatttattgcttttgcatcaacctaataaaaatatacaataaattattaactgtagtcaccctattttgctaccaaatattcattctatctgtatttttgtacccattaaccagcctcactttatcccctgctctctgctacctttcctagcctctagcaactatcattccactctttatagtccataaattcaacaatttttgtcttccacatgtaagtgagaatacgtgatatttgtctttctgtgcctggcttatttcacttaacattgcccttcagtttcatccgtgttgttgcagatgacaggatttcattcttttttaatggctaaataatgttctgttgtgtatatgcatagaattttcttctcattcatctgttgatggacacttaggttgctttcgtagcttggctattgtgaatagtgctgcaataaacatgggaacgcagatatctctttgatatacagattttctttcttttggatatatgtccagcagtggtattgctggatcatgtggtagttctatttttagttttttaggaactccaaactattcttcatagtggttgtactaatttatgttctcaccggcagtgtatgaggattctcctttctccacatcctcatcagcattattgcctgtcttttggataaaagccattttaactggagtgagattgtatctcattataattttgattgtatttatctgatgattagtaagtattttttcatatacctgtttgccatttttatgttgatatgattaggctttgtgtccccacccaaatctcaattgaattgtaatccccatactctccacaatccccacgtatcaaggaatagaccaggtagaggtaattacatcatgggagcagcttcccccatgctgttctcattatagtgagtgagttctcatgagatctgatggttttataagtatttcatagttcctcctgtgttcattatcctccctgccaccctttgtagaaggtgccttccttccccttccccttccgccatgattgcaagttccctgaggcctcctcagccatgctgaactgtgagtcaattaaacccctttcctttataaattactcagtcttgggcagttctttatagcagtgtgaaaacgggctaataacatatgttgtcttttgagaaaagttctattcagatcttttgcccatttaaaaataagatctttttttccctattgagttgtttgacaactttgtatattctggttattaatcccttgtcagagggtactttgaaaatattttctctcattctgtgggttgtctcttcactgtgttgattgtttcctttgctgtgcagaagatttttttagcttgatgtgatgcctttgcccattttttgctttggttacctgtgcttttgaggtcctactcaagaaatctgcccagaccaatgtcctggagtgtttctccagtgttttcttctagtattttcatagtttcatgtgttagatgtaagtctttaatccattttgattttattttcgtatatggtgagaggtaggggtctagtttcattcttctgcctatggatatccagttttcccagaatcatttattgaagagactgtcctttccccaatgtatgttcttggcacccttgtaaaaaacgagttgactgtaaatgtgtgaatttatttctggagtctctattctgttgcattggtctatatttctgtttttatgccagtacaatgctgttttgactattatggctttgtaatataatttcaagtctggtaatgtgatgcctcctgttttgttctttttgctcaggatggctttggctattctgggtcttttgtggtttcatataaattttaggatcattctttctgtgaagaatgtcattagtattttgataggcattatgtttaatctatagaacctttgggtagtttggacattttaacaatatttttccaaatccgtttttttgtgtattctcttcaatttctttcatcagtgtcttataatttcaattgtagagatctttcacttctttggttaagttaattcccagacattttatttcacttgtagctattttaaatgggattacttttttttggtttctttttcagattgtgcactgttgccatgtaggaatgctactgtttttttgtatcttgattttgtatccctgcaacattactggatatgtttatcggttccagtagtttttggagtctttaggttttctaaatataagatcatataatctataaacaaggaaaaacttgatttctttctttctatttaggatgtcctttatttctttctcttgtctaattgctgtagctaggacttccagtactgccttgaatacaagtggtgaaaggatcctgtctttttctagatattagaggaaaggctttcagtttttccccatttattatgatactagctgtgggtttgttgtatgtggcttttaaactattgaagtatgtttcttctgtacccagttttttagtttttatagtgaaaggattttgaattattgaatgcattttggcatcaattgaaatggccgtatgatttttctcttcattctgttgacaccatcaggtactaggcttttgtttgatgggagacatttcatcagtgcatccatcttgctatgtgttattgacctactcaggttttgaatttctccatggtttaatcttggtatgttgcaagtaatgtatctgtttcttctgttttacagtgtattggcactttgtctcctaatagtctctaatgattctttgattttctgtggtatcccttgtaatgtctcctttttcatctctgattttatttatttaggtcttctttcttttttctttgtctgatttaagatttgtctatattttcatcttttcaaaaataaacttcatttcattgaccttttgtattttttattattgatttaatttctgctctgatctttattattttatttcttctactaattttgggtttggtttgctcttctctttgtgttctttaagatgtgccattaggttgtttatttgaagcttttctatttttttaatgtaaggatttattactgtaaacttccctcttagtactgcttttgctgtattctttaggttttgatctgtttgtctccattttcgtttgtttctggaaattttaaaattttcttctgaatttcttcattgaccgaagtggtttttttagaagcatttccatgagtttgtatagttttcaaagttcctcctgctattgatttctagttttattctgttgtggtcagatgagatacttgatacttgatatgattttaattgttttgaatttttgagacatgttttgtgtcctaatgaattgtctatcttggagagcattctatgtgctgaggagaagaatgtgtattgtgcagctattagatgaaatggtctgtaaatgtctatttggtctgtagtgcagattaaggtctgatctgatgtttctttgttgattttctgtctggatgatctgtccaatcctaaaaatgtgctgttgaagtcccaagatattattgttttggggtcttctctctttttagatctaataatgtttgcattatatttttggtgctccagtggtacatatagatttacaattgttctatcatcttgctgaagagactcctttatcattatgtaataaccttgtctctttttgcagtttttttctcttgaaacctatttatgtgatacaagtatagctactccttcttgctttttttttgtttgtttgttgccattggcatggaatatcttttttcatccctttattttaggtctgtgtgtctttatgggtgaagtgtttcttctaggcagcatgtagtggggtcttattttttatccattcttctatgtcttttgtttggagaatttagtccgtttacattcaatattattattgattcgtaagaacttattactgccattttgttgtttgttttctggtcattttgttggtctttcttttttccttctgaattcctttgtataaaagtgatttttttttctggtagtatattttaatttcttgctttttattttttgtatatctgttttaggtttttgttttgtggttaccatgaggtttgcaaataaaatcttataaccagttattttaagctgatgacaaattaattttgattacaaggaaaagaaaaaaaacaaaacaaataagcaaataaaaaactaaaaaagctctatacattctttttggctttggactttttattgtctatatttatatctttttatacagtctacctgaaaaagttgtggtagtttttagttttgattggtttgttttttagtttttctactacagatatgagtgctttatgtatttcagttatagtattaagcgtattctctgtatgtttgtatatttactattgccagtgagttttatacctttagatgatttcctgttgtttgttaatatcctcttgtttcacattgaagaactccctttaacatttcttataagacagacatgttgttgatgaaatcctttggtttttatttttctgagaaagtatttctcctttatgtttgaaggataattttgctggatatatataactttctaggttggatgttttctttccttcagcactttgaaaatgtcatctcgctctcctggactgcaagtttcctactgagaagtctgctgccagatatgtcagggattctttataagttgtgtgcctcttttctctgctgcttttggatctgttccttatccttgacctttgagagtctgaatattatataccttgaagtaggtatatactcaaataagtatttgagtatatttgaggtatctgttggtgttttataacctcgtatctggatatttatatctttctacaagtttggaaagttctcagttattatttctttgaataaactttctagctcaatctttatttctacatactaattaaggccagtaactctttaggataacttttcatcttctttataaaccagaggttgtaaattttgatgaattaccacttattattattttaaaaaatgtctgtactttttgtattctatctaaaagacctttgccaagctcaaggtcacatttttctcatgcgttttctaggagatgttttataattttggcttttgtcctcagatatttgtgatccatttgagtgaattttcatatattgtgcgaagtaagggctgagatttttataaaaataggctgcgtccagtggctcacacctataatcccagatgctcaggagcctgaggtagggagactgctggagcccaagagttcaaggctacagtgaactatgattgtgccactgcactacagcctgtcatttagagacaggcaaaaccctgtgcctgaatgaatgaatgaatgaatgaataaatatccaattgttccagctttttccattgaattaccatggtatctgtgtagaaaaatcaattggccatatatgtgtgagccgatttttgtactctattctggtccattgatgtatattatggttattctagtatcacactctattgattactgtagctctctaaatctggcggtgtaagtcttccatctttttttccattttaaaaagttttgagctattctaggtccttcatattgcaatataaaatttagaatcaacttgtcaatttttgaaagaaggctgcaaagattttaattggggttgcattggatctagagaggggaaaattgagtctttaacaatatggagtcttgtaatgcatggacatggtatatcacttctttatttaggtctcttttgtttcagcagtattttatatttttcaatatactggtgttgtacatagtttgctaaattcctaaatatttcatatttttaatattactaaatggtatttaaaaaatttaaatttataacagctgattgctagtctatgtaaaaattcattttcaaatatgggtttggtcatgcaacgttgctaaacacacttattaatatctgtagcccattggtcaacaacttattttctatatagatgctcatgtggtgtggtaataaacattgttttactctttctttttcagtgtgtatgccttttactaattttctttgtcttgtatttttaggatcattagtacactactgagtagaagtagtgacagcagatattcctgccttttcccttattttagcagggaaatatgcagtcttagcaatgtgtttaacatgacttttatcaggttgaggaaatttacttttatttctagtttgtttagtttttttcatgaacagtgttaaatttcctcgaaatagtttttttttccacatcttttgagaaaaacttttgttttttcattttctgattttttaatatggtgaatggtattgattgacttttacatgttaaactgcaattgcattcttggataaagcttacttggtcataatatattatccttttcatatattgctgaatttcatttgctaaaatcttaaagacttctatgtctatattcataagagatattagagtatgtatttttcttgtaatatctttatatggttttgtaatctggctaatgttaaatgatttaaagcatgtttcatcttttttaagagtttatgtagaattgatattatttctgtcttaaatggttgatagaatttgatcagggaaactatctgttccaggactttgtgagaatgattttaattatgtatgtattttctttactagatatagagatatccaggttcaaattgtaacaaatgacagggttttctccctttttaaggtcaaataagattacactgtgtatatacagttgtccctcagtatatatgggggattgattccaggaccccataccaaagccagtgcagtcggcctggggaatccatatgtaggaaaaattggccctctctgtataggaaaagttggctccccctaaacacaagttttgcatcctgcaaatatggtattttctatttgcatttggttgaaagaatctatatataagtgagcccgcacgtaagtggactcataaagttcaaacccatgttattcaagcatcatcaatatgccacatgtttttcatctattcactccattggatggacacttaggttgatgagcccttaggttgattccatatcttggctattgagactaatgttacaatgaacatggaaatgcagatatctttttgacatgctgatttcatattctttagatgtatacccaatagtgaaattgctgggccatacggtagttctacttttaatttttaggaggcttcatattgttttccataatgggcgtacttcttcccaccaacagggtacaaggattcccttttctccacattcttgccaacacttgttatcttttgtctttctgataataacgattctaacagatgtgaaatgatatatcattttggttttaatttgcatttttctgatggtgagtaatgttgaacattttttcatatacctgttgggcatttgtgtatcttcttttgagaaatgtccactcatgtcctttgcccatgttttagtttggttatttgttttcttgctgttaagttctttgagttccttatatattttcatattaaccctttaacagatatatcatttgcaagtgtattttcccatttcataggttatatcttcagtttgttgattatctccttgctatgcagaagcttgtttgatgtaatatcatttgtctacttttgcttttgttacctgtgcttttggcatcatatccaataaatctttacccaatgaatgtcattaacttctcgactatgtttttttctagtagttttaccatttcgtgtcttatctttaagtctttaatccatttttagttgatttttatatatgatgtgaaatgagggtctaattttattcttctgcatgtggatatccagttttcctagaatcattaattgaagagactgtctttttcctgttatgtgtttaggcatcttcatcaaaagttaattgactataaatgtgtgaatttattttcaggtcccctgttctgtttcactggtcttgtgttagtaccatgcctgtacaatgttgttttcattactacagttttgtagtagattttgcaatcaactaatgggaggcctctggatttgttctttttgcttaaggttgccttagctctttggggctttttgtggtttcatactgattttaggatttttaaaaaattttttgtgaaaaatgtcattgagagtgtggtagggattgctctgaatctgtagatcactgtgggaagtatggatattataacaatattaatttttccagtctgtgaatgtgggatctttccatttatttgtgtctttttcaatttatttcatcaatgttttatagttttcattgtacagatctttcacctcattggttacatttatttatttatttcaagtattttcagtttttttaatgagcaataaaagaaaatgtttcggctgggtgcagtggctcctgtaatcccagcactttggaggccaagatgggcggatcacaaggtcaagagatcgagaccttccaggccaacatggtgaaaccccatctctactaaaaatacaaaaattagctggcgtagtggcacgtgcctttagtcccagctacttgggaggctgaggcaggagaatagcttgaacttgggcggtgggggttgcagtgagctgagattgcaccactgcacttcagcctggcgacagagcaagatttcatctaaaaaaaaaaattcaatagttaagcatgactgaaacttgattatatctgctttttataaaaatatcttgatatctgtgtagataatgtagggttgggattaggtacatgaatagcaacggagttgtggagacttcttagcaagctaaagtggtagtaattatgagagattctggaaatttagctacactggcattagtgggaaaatgtaaactagtttgtttgctttttcagtaaactattttcaagaattaacaggactaaaacatgagaaagaaatgtttgaatgcttctattcagaatgcttctattctttctacattaaagcaaagagacatctagaagtcatctctgtagacaggtgaacagttacattacttaatttcctctgaatcagatttgtgcttaattgctgagagggcaccatcagggagggaattcagattaatgtttgcatagggtgtgcagtggaccagagtatatttttctatgttagcaagatgaactaatctagtgattaaaaaaatacccattaaagtaagatacaaagaacaaatacagttcagttttatcacatttatttcatttctgctgaatttagatactaccaacaatttggagttagctgcagatttttaaaaatggattttttttgttacttgtttagttttttttttttaattatactttaagttttagggtacatgtgcacaatgtgcaggttagttacatatgtatacatgtgccatgctggtgtgctgcacccattaactcgtcatttagcattaggtatatctcctaatgctatcccttccccctccccccaccccacaacagtccccagagtgtgatgttccccttcctgtgtccatgtgttctcattgttcaattcccatctatgagtgagaacatgtagtgtttggttttttgtccttgtgatagtttactgagaatgatgatttccaatttcatccatgtccctacaaaggacatgaactcatccttttttatggctgcatagtattccatggtgtatatgtgccacattttcttaatccagtctatcattgttggacatttgggttggttccaagtctttgctattgtgaatagtgccgcagtaaacatacgtgtgcatgtgtctttatagcagcatgatttatagtcctttgggtatatacccagtaatgggatggctgggtcaaatggtatttctagttctagatccctgaggaatcgccacactgacttccacaatggttgaactagtttacagtcccaccaacagtgtaaaagtgttcctatttctccacatcctctccagcacctgttgttttctgactttttaatgattgccattctaactggtgtgagatggtatctcattgtggttttgatttgcatttctctgatggccagtgatgatgagcattttttcatgtgtcttttggctgcataaatgtcttcttttgagaagtgtctgttcataccctttggccactttttggtgggcttgttttttttttttttttgtaaatttgtttgagttcattgtagattctggatattagccctttgtcagatgagtaggttgtgaaaattttctcccattttataggttgcctgttcactctgatggtagtttcttttgctgtgcagaagctctttagtttaatgagatcccatttgtcaattttggcttttgttgccattgcttttggtgttttagacatgaagtccttgcccatgcctatgtcctgaatggtaaagcctaggttttcttctagggtttttatggttttaggtctaacatttaagtgtttaatccatcttgaattaatttttgtataaggtgtaaggaagggatccagtttcagctttctacatatggctagccagttttcccagcaccatttattaaatagggaatcctttccccattgctcgtttttctcaggtttgtcaaagatctgatagttgtagatatgcggcgttatttctgagggttctgttctgttccattgatctatatctctgttttggtaccagtaccatgctgttttggttactgtagccttgtagtatagtttgaagtcaggtagagtgatgcctccagctttgttcttttggcttaggattgacttggtgatgcgggctcttttttggttccatatgaactttaaagtagttttttccaattctgtgaagaaagtcattggtagcttgatggggatggcattgaacctataaattaccttgggcagtatggccattttcacgatattgattcttcccacccatgagcatggaatattcttccatctgtttgtatcctcttttatttcattgagcagtggtttgtagttctccttgaagaggtccttcacatcccttgtaagttggattcctaagtattttattctctttgaagcagttgtgaatgggagttcactcatgatttggctctctgtttgtctgttattggtgtataagaatgcttgtgatttttgtacattgattttgtatcctgagactttgctgaagttgcttatcagcttaaggagatattgggctgaggcaatggggttttctagatatacaatcatatcatctgcaaacagggacaatttgacttcctcttttcctaattgaataccctttatttgcttctcctgcctaattgccctggccagaacttccaacactatgttgaataggagtggtgagagagggcatccctgtcttgtgccagttttcaaagggaatgcttccagtttttgcccattcagtatgatattggctgtgggtttgtcatagatagctcttattattttgagatacatcccatcaatacctaatttattgagagtttttagcatgaagggctgttgaattttgtcaaaggccttttctgcatctattgagataatcatgtggtttttgtctttggttctgtttacatgatggattacatttattgatttgcatatattgaaccaaccttgcatcccagggatgaagcccacttgatcatggtggataagctttttgatgtgctgctggattcggtttgccagtattttattgaggatttttgcatcaatgttcatcaaggatattggtctaaaattctcttttttggttgtgtctctgcccggctttggtatcaggatgatgctggcctcataaaatgagttagggaggattccctctttttctattgattggaatagtttcagaaggaatggtaccagttcctccttgtacctctggtagaattcggctgtgaatccatctggtcctggactctttttggttggtaagctattgattattgccacaatttcagagcctgttattggtctattcagagattcaacttcttcctggtttagtcttgggagagtgtatgtgtcgaggaatttatccatttcttctagattttctagtttatttgcgtaaaggtgtttgtagtattctctgatggtagtttgtatttctgtgggatcgtttattggaataagagaatagcttggtcattgtggaagtatgaaatgattgtattttaatatacagctactttgttattacaaccagaagcagggttcaaaagccctaacaatgatgaatttcttttattatggccatctacaagtataaaagttttcaaaaaagtggtaatactccaccaacaaatgtaaacaagcgaaacttcaaacctagagcagtaatagagattggtgtttgccatataagctgttgaagggaatcttttgaagacatctacaatgacttcttagagaaaaaacagaccctatgtcaggttcacagtaaataatagccccctcatgtcttaactgtctaactgaatgtttatggaaaggcaagctaggaaataagcccatgatctggtcatttcttggtacatgataaagtacaaaatgtactcttcttgagcgtttagtttacttttgagcctcttaggattcttaaaagtttaaaactagattgggccacctttttttttttttttttttttgagatggagtcttgctctgtcacccaggctagagtgtagtggcacgctcttggctcactgcaacctatgcctcctgaagtcaaacgattcttgtgcctcagcctcctgagtagctgggactgcagaagtgcaccaccatgcctggctatttttttttttttttttttttgtatttttagtagagacagggtttcactatgttggctaggctgctcttgaactcctggccccaagtgatcctcctgtcttggcctcccaaaatgctgggattacaggaatgagccaccgcacctggcctagattgggtcaactttaaaatttatcttatggttgaaattactgtatttctaaatttaaaaatatagacataatcaagtaaagaatatatagtcttattggtagattatatcttggagatataatccttgcttatttttgagtattttattttagtttttaatgttgtaaggggatcttttttggtttctttttcagatagtttcattgttagcatataaaaatgctactgatttttgtacgtttattcatatcctgcaagtttacggaatttttaaatttttttttacagatttttggtggagactttagagttttttacatataacatcatgtgatctgcaaacagaggcaacacttctttccaatttggatgtctttcatttttttcttttgcctaattcctctggctagggcttcttgtattatgttgaatagaagtggtgggaatgagcatccttgtcttgttcttaatattagaggaaaagccttcaacttttcaccactgtagtgttggatgtggacttgtcatatatggcttttattatgttgaagtacattcctttgatacctaatttgctgagagtttttatcatgaaaatatgttgaattctatcaaatgctttttctgcatctattgagatgataatagaattattgtccttcattctgttaatgtggtgtatcacattaattgatttttgcatattaacccatcattgcttctttgggatatatcccattttatcacagtgaattattcttttactgtgatcttgatttttatttgctagtgttttgttgaatatttttccttctatatttatcaggaatattggcttttatatagtgtcattgtctggctttggtattagggtaatgctggccttgagaaataattttggatatgttccctcttctattttgtggaaaagtttgaaaaggattgttgttaattcttctttagatatttggcagaattcattagcgaagctcatttgttcctgggctttctttgttgggaggtttttgattaatgattcaaaaacttgattagtgtttcaatcttatagttgtaatgctcttttaagctgataacatcttaacttagatcacataaaataactctacacttttatgccaactctacccctcatattttatgtttttggtgtgacgatttatatattttattgtatattccttagcaaattattgtagctattatttttgacacttttgtctattaacctttatactacagataacagtgattcacacaccaccattacagtattagaatattttgaattgtgtccttacttttactagtgagttttatactttcatacattttagtctctttgatagctgataggactttgcctgttttttttcaatgtggcagatgttgccttctaattgacagttttagacgatttatatttaatgtaattatcaatatgcttggatttaatcatgctgttttgatttttgccctctaattattctattagtttctttttcctcttacgatttcattttttctccattattaacttcttgagtgtaattgttgatatacttaaacttaggtctactattttattattcagttctttgtgtttcctgttttttattcttgtttcctttttcctgtattcatttggattatttgaacattttttagtattccattttaatcttatcttaatgtgatatttactattatctctttgtaatttttaagtgattgctccataaattaaaaagtaatactttttagagtgtactaagaatcaatattttgtcacatggtttggaatgcggaaaccttacctcattacaggtacctttaccttctcctttcatatgctaccatttcttgtatatttcatctacaaacattgaaaatcccataaggccatgtaaatatttttgctttcaaccatcaagcatactttaaagaactcaaaaagagaagaacagtgtattgcatttacccagaaatttaccatatctattgttatttcctcattccaagttgccttctgcttcatatcccttcatctgaagagcctcatctagcatttcttttagagcagctccactgactgtatagattatcttagtttttctgcatcttagaacgtctttatttcacacttatccgtgtaggatatttctgttgcatatagaatcccgagttataattattagcacttaaaaaatgttgggccacttctttctggcctttatggtttcttatgataaaaccatagtcatttaaattgttgttcccttatataatttgttatttttctgtagcagctttcaagatgatttcttcatttttatttttcaacagtttaattgttacatgcttggtgtggatttttttgaaaataccttgtttgtgatttgctcaggttcctgaatctttaggactattattaactacatctttttgttttgttttttcaaatggttgctgtattatttacaatatacatctttagcttatcacattctacctttaattatgttatatcacttcatatatagtgtcagaaccttaaaatagtatacctgattttttaaattgtttctcttgagctaatatcatatctatataggttataaagaacacaataaattgttctagtgtttgtttttaacagtaaattatcattttagagagataaaaatgatagatgatttatatttatccacatattaactttctcctattctctttattcatctgtataaatccaaattctgtataatattctttttttaaattatactttaagttctagggtacatgtgcacaacgtgcaggtttgttacataggtatacatgcgccatgttggtttgctgcacccatcaactcgtcatttacattaggtatttctcctaatgatatcccttctccagcccctcacctgccgacaggtcccagtgtgtgtgatgttccccaccctgtgtccatgtgttctcattgtttaactcccacctatgagtgagaacatgcggtgtttggttttctgtccttacgatagtttgctgagaatgatggtttccagcttcatccatgtccctgcaaaggacatgaactcatccttttttatggctggctagtattccatggtgtatatgtgccacattttcttaatccagtctgtcattgatggacatttgggtttgttccgagtctttgctattgtgaatagtgccacaataaacatacatgtgcatgtgtctttatagtagcatgatttataatcctttgggtatatacccagtaatgggatggctgggtcaaatggtatttctagttctagatccttgaggaatcaccacactgtcttccacaatggttgaactaatttacaatcccaccagcagtgtaaaagcattcctatttctccacatcctctccagcatctgttgtttcctgactttttaatgatcgccgttctaactggcatgagatggtatctcattgtggttttggtttgcacttctctgatgaccagtgaggataaacattttttcatatgtctgttggcaatagcaggtataattttcattcagcccaaggaattttgttgtcatctcctgtagggcaaatctctgatttttttttcttttagtctggaaatttttgtttcactttcatttttgaaaaaaaatttgctgagtgtagaattctattttgatagttttcctttgtttttaatatagaattatgggttggcagttcctccccttgcccccccacattttactagcttaaaaatgtgactccactgtcctctgacttgcaagtggtttctgatgaaaagacagctgtcattcttatctttgttcttctgcttttttgtcttcataacttcatgaaattcttggtgtgagcttctttatatttcccactcccccatcccgatcttgtgtgtattttgttgcatttctcagtttcatggaattacagattttgttaaattttggaaattatttcttcaaataatatttctgtccaccacatcactatcacatatctcaaactcttatcactctggattaggctgcttgatattgttatccaggtttttcaatctttttcatttatgtgcttcattttggacagtttatatttctttataagttcactgttcttctgtaatctctaatcttgtgctaattctgttaaatgtatttttcatttgaggcattcatttataggcattctatttcatttataggcattctattagtttctaaaatttttgctattacttgttatcatattcatgttttctgcaacattattaaacatatttgagtatatttccaatcattttttaaaacattctgttctaccacttctatcttttgttttatttctgggtctctttctattggatgattttctttttgttatgaattatatttcctttgccttctatactttttaattttttcatatgttttaggcatgtatattttaaacttattggctattagattttgttgtattcctttaaggggtgttggactttgtgctgacacacagttaaattgccttttaccagcttgaacattctgggagtttgctccttagtcttgttagagtggatccagagcaactttcagtttattgctcatttattttggtactacatctcttctcaggactctacctaatgcctcctgtagtacgaggccatttttctattgttgcttggagcacaaactgttcccagtgctgtgtaagactcaagaggtgtttactagttttttcttggtcctttccatagccttaagtagttttcccgttttgcacatgcagatcagtactcagctaaagacatgtgggacttttctgcagatctctgtgttttctgtgtgtgcaagctggtttgatttctttcttttttttattattatactttaagttctagggtacgtgatttctttaaactctaaactttgttttctcaagttagtgagatcaccactctattttggatctcactgagtttctgtttaccttacaagtaatcagggtaattcattatgaaatatagtatttcacttaaaatactacggaagcaaaaactactataaaagtaaaaaataaaaatgactcaaatataacaagagttcttcattaggccatgatggagtaatttggaaagcatttcctgccataaacaactcaaaaaccagaaaaaatatatgaaaaatgcttcacagatgttggataacaagcagaagtaaaatatttatttctctttaaagaaagagaaatatttatttcgcactaaaaagtttatttctttctctttacttcctacatcttgtgtcatggccagggtattgcctacaagcagtatgctctggcaatcatagagcctacacttgtttctgtttcttttagagtcatagtcctatgctgtcacaggatcacagtgtaatgctgcttggtatctagtatccataaagcattttttattttgtttttttttttttctggtttctgagttgtttgtggcaggaagtgttttctaaattactccatcatggcctaatgaagaattcttggtatatttgagtaatttttgctatttacttttgcagtattatcctgagttagttcatgtattcatgcatctgttttcaccactgtcttttctcattaatgacctacttttgaaccagtggtttacttttttataaattgagaatatgataaagcacactaccaaattgaaaaaaaattcacgcatatgcaaataacaacagaggataagaacatatgttttctgaggtgatctatatgttgttatcttgcatgtttattgagaccagttggttccttagagcatatatacatttccaaatgcaaaacataagaagaatataatgagaatgtgactcaaattaatcttgcttttcaaatttgtctcctgtgtgggaagacaattgtttccttttaatttttcacctgaaactactataccacttatgaattccttgcctgaactgctagtgactgaacctagagaaacattgaggtagtacaagaatgcacattttggtgttagacctgtgtcttcgctcttacaattccaaagtttttttaaaaaagtttatcaagtagttaagtgaaatactgtatttcataatgaattatgccgattactggtagctgatcactagtagtgaacattatatttttaaaataaactttttattttgagataaatgtagttacaggtatataattgtaagaaataatgaaagtgattctgtataccctttacacagttttctctcatagaaacatcttgcacaaatgtgtaacatcctaagtctagatactgacatggatataatcctatgatcttacttagaaattcccagttttatttgtatttgtttgtgtgtgtgtgtgcctatttcattctgtgcagttttatcacacatgttgatatatctcccaccacagttaagatacagagtagttcttcaccccaaagatccttctcattgcccctttaaccacacatacctcctttctaccctggctcctcacaaccaccagtttgttctccattttataattttgtgattccaagaatgttttatatatggatcatttacatttaaggtaattttgatatattagtgactaagtctgctgttttattatttgttttctgtttttttccttttcttgtgcctctttttctctttacttgcttcctgtgggttatgtgaataatttttaggattcctttttgatgcacttgtatagtgttcttaatagtatctctttgtaaaattttgatagtatcttctgtataattttcttagtggttggtctgtgtgttaaaatatatatatttgacttatcacagtctactggcaccagtaatttaccacctcaggtgagatgtggaaaccttgctttcatttacgtcactttagctttacttttctcacttttaaatatcattatcttgagtatcggatggtgttataatttttttccatcatcatatattatttataaacattcatgagaaggataatctgttgtttgtattcatgtttctgctctatttgttgtcctgacttctttttttttttttttaattatactttaagttttagggtacatgtgcacattgtgcaggttagttacatatgtatacatgtgccatgctggtgcgctgcacccacttttctgatgctccaagcttccttcctttatctttctgtttgaagaagttcttttaaccattatttaaagagagacctgctaatgacaaattctttttttttttttaatttaagaattttttccctcttaattcctgaaggatagtttcactggaggtagaattcatactttacagttctttttctctccagcatttgaaaacagttgtgctacttcttttggacctccatggtttcagatgagaagtccattattattaaaattattgtttttctaggtaatttgtcatttcactctggctgctttcaaggtttttttccttgtctttagtttttagaagtttaattatgaggtgtcttggcatggatatctttgggtttaacctatttaagatttacttagtttcttgaatctgtaagtttatgtcttttacaaaatttggaagtatttggccatcatttcttttttttttattatactttaaattttagagtacatgtgcacaatgtgcaggtttgttacatatgtatacatgtgccatgttggtgtgctgtacccattaactcgtcatttaacattagttatatctcctaatgctatccctcccccctcccctcacccacaacagtccctggtgtgtgatgttccccttcctgtgtctatgtgttctcatcgttcaattcccacctatgagtttaaaaactctgtaagccccatttctttttcttctccttttgggattatggtgctacaaatgttggatcatttgttattgtcctaagggtctctgagactctgttcactgttttctctatttttcatattggataaattttatttatttttatttttaattttttgtttatttttataattttaacttttattttagattcagggggtgaatctcaatgcaggtttgttatgtggctgtattgcatgatgctgaggtttggagtatgattgatcttgtcacacaggtgtactgagctcagtacccaatagttattcaccccttgccccactccctctctcttgataaattttattgttctgtcctcaagtttaacaattctttcctttgtcatttccactccggttttgagcctatcccgttagtttttatttgttattgtagttttttttaaacttttttttttttgctgagatatttttgtttgtttcaagataatttgtaatagtagtgaggttgcagagaaaaaggaatgcttatacactgttggtgggagtgtaagttagttcaaccattgtggaagacactgtggtatttctcaaagacctaaagatggaaataccattcaactcagcaatcccattactaggtatatatccaaagaaatatattaataaattattctattataaagacacatgcacatgtatgttcattgccagcactattcacaatagcaaagaatcaatctaaatgcccatcaatgatagactgaataaagaaaatgtcgtacatatacaccgtggaatattatgcagccacgaaaaagaaagagataatgtcttttgcagggacatggttggagctgcaggccattatccttcacagattaacacaggaacagaaaaccaaatactgcgtgttctcacttataagtgggagctaaatgatgagaacacatggacacatagagggaaaaaatgcacactggggcctattggaggtgaattgtggaaggagggagaggatcaggaaagtaactaatgggtactaggcttaatacttgggtgatgaaataatctatacaacaaacccccgtgacatagatttaccaatgtaacaaacctgcacttgtaccccaaaacttataataaaagttaaaaatagttatagttacatgttggagtatttttatcatggctactttaaaattctttttagataattttaacatctgatccattcatctcagtgttagtattacttgattgtctcttctcattcaagtcgtgatttttcttgttgtcggtatgacagggagtttttgatcatatctttacattttgggtttcatagtgggagtctctgggttctattttaaatcttttatcttagcaggtagtcacctagtttgggttttgcattcaggtcttgtggtgagatctctctttgcagtcttaggccttgtggggaaggggagtgctttccctgcatatttactgtaagtagtatttggcaggtcccttttgctagggctgccagggtcatctggttttgtccattggactcgtgttcagtttggctaaggaataagcctacccaagtaaccttttgttctaaggatgggggttgagaagtgctgggcctcagtaaccttcttctgttgggtgagtgagtgtcatgagacacacattctccagtccctagccagtctgccttcgtctttacactttagattttttctttggttgtctcttacacagtttctaaggtctgtggggggagcagggaaaaatcagtctacactatcttgttccacttattaacttttaaacttttgatgtgttattcaatttttctagctttgaatttcctaatttgtaaagaagagatagcaataatataaccctccaaagattattattaaatgagataatgagatagttactgagaactgtgctctattagagaatgatgctgctgttgattgcaaggttgtttattgcaccattgtttctaagggcaaattgaaacccaaatgagtaacaaagtagagttatttaaataaattgtatattatcaacacaatgaaatttagctcttaaaaaagtaataaatgggacacagaatgatgccccaaatgtcttgttaagtgaaacagtagttgcaacatagtatttttagtacaaatatgtacacacacacacacacacacacacacacacacatatatataaacatatctatctaaaaaacatgtacatgtgttttatgtatacgaaaatattcagaactgtagtttgaaaatagtctgtatgtaacaaattgtgaaatgtacctctaggtagtgggctgggggaaagggtaacttttacattttatacctcttaattcaatattttttggtaaggatcaagtttatctttattaaaaggaaatgaataaaactatgaaaatcttttagttcaaatatatatatatatatatagttaagtggttaaagaatattaatcaaattatttctgataagttgtcttttacttcattttttggaaattacctccaaaatgtaatgcctgttagttacatatgagttccgcaaagtttcttaacatagattaagtaccagtggcttggatgacttttttggatatttctattttttatgatcattgtagaatcattttctttactaccttagaattttgtaaatgcaaagaatttttaagcattatcattttctattagttgatttgggtattttcaatgagctgactaggatgccacattttaggtggctggttagaggaatgatggagatgtgatctatatgcatatttaaaaacaaatgacagatttttatatagctgctttttataataaattttctaaggccaagaaattgtgggcttttcgtatgcatttcttaaaagcatcccttgcatatgattggtgtttttattagtgaaactgcattgggaaatgaatctattgtagatacagcaagcagagtgggattttaatatcggaaattagttacaaaagtgttagaaggactagagataccaaagggaagggatcacccagaaatccagaagtgctacatacctaggctggagcctatgatcacatttgccactgagcaactaaacataccagttttgctactgagcagggaatacctattaagccagcactgccattacttactgtaattgccttcctgttcctgctgctagaggcaaaatcagaatctttcctcttgccctttaatctcatactagtactcccattggtggaacctaatgtaacacaattgtcaagcgagtcttggaaattttattgtttaggttttcatcctctgcaatacaaaggactttataaaaaggaaagtggggcttataaccaacaaataaaggaccagcacagtactaaaaatgtgttcaattaattttagatttctaagggtagggatcatatcattttatctttataatgtcagtgactaactgtcacatagtaggctctcaaaatatttgttaaaaatttttttcagagctatttatgtaatataagaataaagttttcctttttctcttgcaaacacataaaatgttctttttagtatttcagagtttaacttcatctatggaaagaccagtgttactcaacttcaaacccagcacctaacctggcacatacttaataagtgtttcttgattaaattaatattagatatacaatgtttactcataaaaatatgtcattagaattaacttgttggtattttggtgatatattagttatatttaaaaatactacttgaaatttataatgtattttatttctgttacagcatcaaacacttggcttgttccagaaactaaaggagctattgtacaaggtggatatggccatactagtgtgtatgatgaaataacaaagtccatttatgttcatggagggtataaagcattgccagggaacaaatatggattggttgatgatctttataaatatgaagttaacactaagacttggtgagtacacaaaataacacattttctatgttgccattattattgtaaatgattgactttaaaatggtttctgacatagaaatacttactttatatgcattcattgtaaatgctgatatcgtcttaatttcagatgagtaattttgtttaccagtatgacttcgatatcatctgttcagggatttgttcttctttgcactcatattttattgtcatctgtaaattttaaaaagcatttatttagtttcatcatctaacttcctgtgaaatacagagcttgtggcatttaggtaaattttcaccttttgttgttataaacaatgctacactgcacttcttgcactgatcttttcatgtacatatttaagagttgctctagggtgcatacttaaaagtgagatttttgtatctgagagtatttatatcctcaactttattacatgttgccgaagtgcttttcaagtcactgtggtaatgtgtatatacttccaccaacagggtatgtgtccctgatccttcatgttctcaccaacacttgaaaattgtgagaatttttacttttgccaaggtgatgggtgtgaatagtattttaatgtgcattttcctgattagtattgtaaacatcttcttatgtgttgatttcctattgtttcctgtttagtgaattgcctactcatatccataatattctctttatgtttgaaatattattaattaatttttcatttattggtttttttggttatagaagttttaaaataaaatttttgttctaatttttctttgtaaaatctgggaaatgacttttttttcttttaagacagtatacattcttttaaacttctagcattaagttactttatgtgatcaaaggaaatacacaggtttccatcaaatcatgatttgttctaccctcttcactttcatacatatatcctaatttctactttttaaaaaaatatagaattataacaccttttttcttttggtaattttgataattcttatttttagtctaataaaatgtagttttattctttatatttttatattcatttttattttgtataactcataaatagcatcttctgtacatttaatatttgtaaatttttctctgacattttgctatgttagcaagtggaattgtggtatagtgatgaaggtactatcagtctgttacacattttaaacatgtatttaatttaatttaatttatttatttgagacggagttttactcttattgcccaggctggagtgcagtggcacgatctcagctcactgccacctccacctcccacgttcaagcgattctcctgcctcagcatcctgagtagctgggattacatgcacacaccaccatgcccggctaattttttatttttagtacagatggggtttcactatgttggtaagcctggtcttgaactcctgacctcaggtgatccacccaccttgacctcccaaagtgctgggattataggtgtgagcaactgtgcctggccctaaaaatattttttcaatgctgtgtcataccaaaagggaagaataacttctgtatgaaggaggcagtatagttcacagtaataataatgggtatagcaatgctcaggtaagaagaatcttaatgaaagtgaatggataagagagcagaattggatattatttgtgtaaagtcaaaatgagagattcagttgttgctcactacttgaataaaattttgttaaattttccatgattttctacctgaaaactttacatagtgaaagttttgcctagatgaatattattgtcagccctggcaattttagtatgtgcacaaatggcactggatatttatatgtaaaacaatttactaaaataatttgtaaattattttaaacacctcattacaaatatgttgtagatgtatgatgctttaatattttaatgggtcttaaatttctttaaacacacaaagttatcagtgagcactaattgattttttcattatccttaaaatttgtagtattctttaagcttagatcttttttagcatatttgtcaagtttgctattatatatggattatgtcagtggtccccaacctttttggcaccagggactggttttgtggagacagtttttccatggacccagggaggggagatggttttggaatgattgaagtgcattatatttattgtgcactttatttctattatttttattacattataatatataatgaaacaattatacaactcaccataatgtagaataagtgagaatcctgggcttgttttcctgcaactagatggtcccattctgggggtgatgggagacagtgacaccgaaagtgttttgcctatgttcagtctactccataatctcattttggttgctgtcactgcagaaaactctgctccacgaagacaggatgctggaaatagaagcaggctttttggtgcttttgtggcaatctcaggatattctgccttgactttaactcacaatgtatagtgatttgaagttgtcttaaacatacttttaaggctactgtcatttgcgatctcatgcagttgatcctcttctagcatggacaaagtcgattcacctggcttactcgcaaatgggtcgcgtatccattccttcccagtttggggtctttttgaagttgggaagtaatgctgaaattcttttgtaagctgtaatagttgttcatgcaccagctgggagaaagatggtgctgggagaaaaaaatctcttctaatgtttgaaacatgtcagaaattcgagagtttacttgtcgcccccataattccagtttggcattgaatgcagccactttacctgccaacttgaatgcagttgttattctctcctgaagtgacagaatgagtttcttgagcaggttgaatatgtcacacaagtaagcaagttttgcaacccattctgtgtcactgaaatgtgctgccagtggtgactgtttttctaaaagaaatctctgcagtagcccttgtaagttgaaaactctgaccagtgacccacctttagaaagccacctcacttctgtgtataagagaagacatgcggccgggtacagtggctcacgcctgtaatcccaacattttgggaggccaaggtgggcagatcacgaggtcaggagttcgagaccagcctggccaatatggtgaaaccccatctctactaaaaatacaaaaattagctgggcatggtgatgtgcgcctgtagtcccaggtactcgggaggctgaggcagaagtgcttgaacccaggaggcggaggttgcagtgagctgagatcgcgccactgcactccagtctgggtgacagagtgagactccatctcaaaaaaaaaaaaaaaaaagaaaaagggatgacgtgtgtgctttgcacccatctcctcacagagctgtgtgaacagatgtgagttgagggcatgtactttaatgtggttgataattttcatcacatcttgctaaatattgttaagttcaggtgacatttttcgcctagccagcatttctctattgatgacacagtgagtagactcacattcagaagcaacctctttgacccaagcagtaaaaccagaaagctgcctagtcatggcagatactccatttgtgcgtatattgacaaaaaatgaccaattcagttttcctgatatgtaatcattcaaagatttgaatacttctgcagctgttgtgttggttgtcaacaaaagttcacataatagtctgggcatggtggctcatgcctgtgatgccagcactttgtgaggcagaggcaggtggattgcttgaacttaggagtttgagacaagcctggctaacatggtgaaaccccatctctactaaaaatacaaaagttagccaggcatgatggcacacacctgtagtcccagctacttgttggtctgaggtggaaggattgcttgaacctgggaagtggaggctgtggtgagccgagatcgtgccactgtcctccaggctgggtgacagattgagaccctgtctcaaaaaaacaaaaaagagagagagagagaaatgtgcacataacatatcctcgtgcacagcctcctgaaaaatatattgcacaaaaacaaacgttttattgtcaacatcagttgactcatcaacctggattgcttaccaaggtgacttattaattctctctaacaattgtgcctcagtatcctctgctatttcatcaattcctctagttatggtgctagctgaaagaggaacacatgtcaccttttgaactgcagtctctcctaaaagactacaaatgtcttcagcaataggcaggatcaactcttcatcaatagtaaagggcttctatggtttagcaatgctgttagctactaagaatgatgctcttagtacagacccatttgatgaagtggtggctttcaataattgcttcggctcttcgtgttcactttttttcttttgaaaaactccaaaggcttgttttttaatgcagggtgcttggtctccttgtggtgaagcagttttgaaggtttcatggtttcattggatggctggttgcaacgtattgtacaaagtggacttggagaatgtgaatcacctgttgtaatgaacccgtaatttaagtaagactcttagtattttctttgaaatgcagctttctttttgttggcagtctaagagtcttctgctatctcatcattcccccttttcaaagaagctctccagtgatgtttgttttttactcagtttggctaaggtttgtttgtgggcttaccaaaactgtaactgaaacaagtgtgcagtgtgggaaagaggtgtggacagaaatggtaaataaaataatggggggggggggcggggtcaggcagtgcccgcatggactaaaataagtattagattctgccttcaagcttgctaccagatgcgactgtaaaattgaagtacatcatctcacttgccactataaagcctgctaccagatgcagcttaattatcacttgccactcactcactgatagggttttgatatgagtctgcaagcaattgatttattgtggtccctgtgcactcaaacctctctgctaacattaatctgtatttgcagccactcccaagccctatcatcatcacctcagctccacctcagatcatcaagcattagattctcatagggacatgcaacctagatccctaacatgtgcagtttacaatagggtttgcactcctatgataatctaatgttgccactcatctgacaggaggtggagctcaggcagtaatgcgagtgatggagaatggctgtaaagacagatgaagctgtgtttcctcacttgctactcacctcctgctctgctgcctggttcctaacagggtgttgagaaccctgggattatattgtataggatgtcaccattatgtgtccattatgtatcagtattatgtatccactgtatagactgatatttattttttaccacctcagaactggtttcggtttttagtagatatggttacatagatagggcactttgttgagatactaggaaatgtgttttgaggacttattctttttcagtggtgaaatgaattcttttggactgttacttcccctgagaaaaattaggaattttatttgcctaaagcatgagagaactatcaaaaccatgagaatttgtcagagatttaggagaggtacaatgtcaagggatacaagacaggcattttgtgtaattttaaccttgagacagttagaaatcctggaaacctcctgagacactgagcagtccttttgtcagccattacagaggaacaaaattagatatccagatgtgccaaggaagaggagccttggtacatacttaaggatttagtctggcccctgagattctaaaccctactcgtgataattagcccacctttgaatcatcataatcttttattagattatggtgaaatgcccataatgtagttagatggcaacataaaaagtaaatactttattgagtgagataacatcatatggaggcttaaagtatttcttctatatatcatatacaatatctggcacaaactaaaaaaaaagctcggaagaagataagatacgaaaaaacaacatccgttagaaacatacatataggataatggagtgttttagacacaaactttaaaataattattgttatgttcaaggaattaaaatttaaggtagagaatattaggacaggcctggatactcatacttatgaatcaaatggaaattctagaactgaaaaatacattgagtaaattaagaattccttggatggaaataacagcagattagacacagctgaagggggaaatatgaaatggaagagagatcagaaggaaacatccagaaggaagtaaagaaagacaaaatgatgaccaaaaaaggacagaaagaaatacaaggaagatgtggaaattgtctaacccacatgtgtaattggaatcctaaaaagagaagagtgaagacaaatgtgtaacattattttaagtgataatgaataagaaattttcaaaagtgacaaagacatcaagccacagattaaagaagttctgtgagcaccaaggggcataagtacaaagaaactcagaaatattatagtaaaactgctgaaaaccaaaacatgaagacaaaaatttcaaagcagatagaggaaaaagggcatatttcctttaaaggaaaagcatgaagacaattaattttttaactgaggaaatgggatccagaatacatgttttcaaatagcttaaagacaataatcatccatctaaaattctacataattaaatattcttaaaaatgtaagcaaaataagagcatttttagaaaaacaatgactgagataacttgacagtagtaggctttcgataaaggaaatactaattacaataagtgctattgaagtagaagaaaaatgatcccagatactggatggaatgtaatgaaattatagagatgattctaaatgactatcatataaagctatagtaataatagtggcttgcatatacacaaaatttaaatgcatggtcctaatagcacataagtcagaaaaggggtaaattagtgttaaaaagtctgaaagttggtcgggcatggtggcttatgcctgtaatcctagcactttggagagctgaggtgggcagatcacttgaagccaggggttcaataccagcctggccaacatgctgaaaccccatctccactaaaaatacaaaaaattagccaggcatggtggcatgtgcttgtagtcccagctacttgggaggctgaggcacgagaatcacttgtacccgggaggcagaggttgcaatgagctgagatcgcatcgctggactccagcctggacgacagagactctgtctcaaaagacaaaaagaaattccagttatactaaatgtgacagattaaatattccagttaaaagccaagaatttttggattggatataaaaacaaaacttagccatctgctgcttagaaaagataaaccttaaataaaaatatttagaaaagttgaaagtaaaaggaaggcataacagttcttaatttatatataatttataacagtgttgaaataatgtaaaattgaccaaacacaagagacaaaacatagtgagatgtttttaacccaattttcttggtaactggtagtaccaggagaccaaaaaaccggcaagaacataaaacatttgaataggacaatgaacaattttgtctcacttgatatttgagagcataataccttataattgaagcatatacatggtttccaagaacaaaggaactttcccggaatttactatattctgggttttaatgcaagtcttaacaaatttaaaaggattaaaataatacaaattaattgaccacagtgaaataaaaagtaactttttggtgattacataaaaataataagaaaaaccctaatatatatgtgtatatatatttatatataacatatgtgtatttaatatatgtgtgtgtgtgtgtgtgtgtgtgtgtgtgtatatatatatatatatatatatatattttttttttttttttttttttctttgagacagactctcactccgtcacccagcctggagtgcagtgacacaatctcagctcactgcaacctctgcctctcaggttcaagcaattttcctgcctcagcctcctgagtagctgggactacaggcatgtgccaccacgcctggcaatttttttgtatttttagtacagatggggtttcaccctgttagccagggtggtctcaatctcttgacctcgtgatctgcccaccttggcctcccaaagtgctgggattacaggtgtgagccaccgcgcctggccaaaaaaccctagtataattttcatactgaaaattttcatacttaaaattactgaatgatgacacatcaaaatgcatgtgattcagctaaggaggggcacttatagatctaaatgcatttattagaaatgattttctaaaagtctgaaaatcagtagtctaagaatccccttgagaagttagaaaaagaacagcagactgatcccaagaaaggataaagaaaataaagatataataaaggaaaggaacatgagataagagcatgaattaatgaaataggaaacatgtgatagaaatgatccataaagccaccaaaactcgacaaagttggttgtttttaatagtaatagataaatccccacacagacttagaaacaaagattacttaaataatccatgccaagaatgaaaagggatatcatgacagatcacatagagattaaaagttagtaagaacatatgataagcgactctatgaccgtaaatttgaaaaagtagatgaattatgacaaatttctagaaaaacaaaacttaccagaattgacacatacatgaacattgaaataatcttatgtcaaataactagaatttttaattgaaaccttgttgcctcaaaatacagaagcatacatacagatgaacaaataaaaacaaaacaaaacaaattctccaggccgtgatcactttactggtgaattttcccaaatatttaagaaataagcatttaagaaataaataacatcaatctttcacaaactttctggaaacagaaataattatgttgagatttatgaggccagcataaccttgatataaaaatatgaaaaggatgttacaggtaaggaaaattttagtattgtcttttccatggacgattccagcaatttagaaagaaaataatagattatttgggttcattcaaagaatataatgttacttaaaatttataaaatttgaataattaagaaaatagagaagtaatggtctataatcttgaaagatgcagaaaaaattatagataaaatttatcatgtatttatgataaaacctctggtgaactaggaatggaagcaaatcatttatgtggtaaaatgtacaaggacacatgaaaactttactgcaagcattatggtgaaatagagaaagctttccctctaagattgggaatgggataagggtgctcgctgtcaccacttttattcaacattgtattggaatttccagccagtgtaataaggcagattaatataatataatataatataatataatataatataatataatataatatgtatatgggtaatcagttgctgcaaataacatcaatataaaaaattaatccagagtaattctgtataccaggaacagtttaaaactgataatttaaaaataatataatttatgtcactgtcagaacattaataacctaaggaataaatctaatgacttatgtgcaggatctttacacagaaaactataaaaccttattgtgagaaattaaataaaatttaaatatatctcagaccaaattatgacaattgtttgaaaaactcaatattatgcagatgtctattctgcccaaattgatctgtagatttaatgtgatcccaaacaaaattttagcaggtgtttttcttttggaaattgacatggtgattctaaaatttatacaaaaatgtgaagggtaatttttgtataaattttagagtctccgtgtcaatttccaaaagaaaaactttagaagaacaaagctggaggacttttctatccaaattttagaagaacaaagctggaggagttctctatcagatctcatcacttatgattttacaataattaagtgttgttgcaaagacagggaaatagactaatgcagcaaatagaattccacagacagacctatatatttatgggcacttaatctatgacaaaggtggaactacagagcagtctttcttaataaattgttctgggccaattgggtgtacaattggaaaaaatgaatattaagccctacctcacatcatcataaacaaagatctgtttcagatcaatgttagatctaaatgtggaagtacaataatattctagaagataacagaggcaaatatcttcatatttatgagtaaagaaagatttcttaaatggaatttgagtagttttattagtaaaagaaaaatgatagactgaactatatttatatgtctaaaaagtcagtaagaacacaaacatgccatgctcatggatcagaagaatcaatattgtaaaaatggctatactggccaaagcaatttacagaatcagtgctattcctatcagactaccaatgtcattcttcccagaattagaaaaaaaaaactatcctaaaattaatatataaccaaaaaagagcccgaataaccaaagcaatcctgaacaaaaagaacaaagctggaggtatcacactacctgacttcaaactgtactataaagctacagtaaccaaaacagcatgatacaggtagaaaaatggacatgtaaaccaattgaactaaatagaaaacttgaacataacgccacacacttacaatcatctgatctttgacaaggctgacaaaagcaagcaatgaggaaaggactccctattcaataaatgatgctggataactggctagccatatgccaaagattgaagctggacccctacctttcaacatatacaaaatcaactcaaaatggatcaaagattgaaatgtaaaacctcaaacaatacaaatcctaacagacaaccaaggaaataactcttcttgacattggccttgataatttttggctaagtccccaaaagtaattgcaacaaaaacaaaaattgacaagtaggacctaatcaaactacagagctcttcacagcaaaagaaaccattagcagagcaaacagacagcctacaaaatgggagaagatattctcaaactgtgcatctgacagaggcctaatatccggaatctgtagagaacttaagtccacaggcaaaagacaaataaccccattaaaaaatgggcaaaggacatgaacagacacttctcaaaagaagatatacaagtgcccaacaaacatgcaaaaatggtcaacatcactaatcattagagaaatgcaaatgaggtatcacaccagtcagaatggctatttttaaaaagtaaaacaacaacaacaacaacacagcagattcttatgagactgcagagaaaagtgaatgcttagacattgttgatgggaatgaatgtaaattatttcagccactgtggaaaatagtttggagatttcttaaagaactgagctaccatttgacccagcaatcccattactgggtatatgcacaaagggaaataaataaatcattctaccaaagagacataggcacttgtttgttcattgctgtgctattcacagtagcaaagacatggaatcaatccaggtgcccatcaatggtagattagattaagaaaatgtggtacatacataccacggaatgttatgcagtcataaagaagagtgaaatcttgtcttttgcagcaacatggatgcagttggaggccataatcctaagagaaattaatgcaggaacagaaaataaaataaatcagacataaaagaaaacagtatattcttctattgatataaagttcagcaccaggaaaaacagaattatgggcttagaagttatgatagggattgcctatgattgtgtagtatttgaatgagtagcagcaaagcttctggagtggttatgtgttcactttgtgataattcattgaactatacacttaagatttttatacttttggcatatatattatacttcataaaaatttataaaaaaatagaaatctgagttcaatttgacttcttatatgctaaaagattatgataatttgacataccaaaagagggtcaattttttatgtaaagttagcaaattacgtttttattatcagtgttagaaaagaatggagacataaaatttcagtcatttctgctatcccactccttcaggagtagttgcatctggtttcgttacatttaataagtaagagagaataaacatcttgaacttataggagttcctgttgctcaaaaatgattccttttatgtttttggtatattttgctgattcatattatctttgctcaggcactttaactttggtgtaatgattttgaatattggggtcattgtgatcttcattttatagccttgttaaatgaggcatctcataactttctttgcatatgtttgtacaacttataatgggagcttatgtcttcattatttttctatgtgaagacttttctctgatagtggagacctcagattttcttggcctattgtttaggtcttttcttcaattgttgtattcctttagcctgtgaaaaagcacagtaagttttaacacataaggaatttattaaactttaccatttataactttcagctgtaattatcaactttttatttttatttttatttttttccagtgagggaaaaaagacttcaattatatttctttctttcttttttttttttttttgagatgaagtttcgctcttgtttcccaggctagagtgcagtggcacaatctcggctcactgcaacctctgcctcccaggttcaagtgattctcttgccttggcctcctgagtagctgggattacaggcacctgacaccacgccaggctatgtttttgtatttttagtatagatggggtttcaccatgttggccaggctggtctcgaactcctggcctcaagtgatccacccacctcgacctcctgtagtgctgagattacaggcatgagccaccatgcttgcccaacttcaattatatttctacagatattaaaaagataggtagtgaatctaatggtaatgcttctgtggtacaaattaattctgtacttttaaaatgtctttctaatcacatatacttaaaaaatgttttcataggccacacctggttacatgaaatgatttaatctagcttcaatttgatataatagaagttgtttttacattaaaatattaaaaactatgttatgaaattatttttttttgtgatttctctaaaaaatttcctgtccgaggttttggaaagcgatagaggttaattttataaattatgttattatttaaaacccatttcagtaaatactgatgaacatcagcatttttctttctctgcttactgagtgtctgaaatcttttcaatgaaaattttgttggctctttatcaagtcctgttttggaaataatcctaagtagttctcagtaagggagattgagaatttaaaatttaattttatatatttatgagggaaataatagaaatatatacgcacacaagcacacaaacatatagttgcgaagtaagatatcagagatttattaaaatgaaaataaaatgtttatacaggcaaaaagactattatctttaaaaacatcatgataagagatttggaattttggaatgtctggttaaaatcccatattgataatttaaataagtacttatctctgtagctttgcttttcacagtgattaaaaaatttgtagtacttattttttactagttctcttttataaattgggaaatatcacatatggacaaaagactgtatgatagtatgtatatatagtttcaaaaccataataaaatgaattccctgcctacctgtgctaagaaagaggacattacaataccctagaagcccccatgtgtccctttatgattgtatcccttatattatccccctccattattcttaatattgtgttatttccttgcttttcattgcatgtttttaccctccatatatgtatttgccagcaaacctttcatttagtttttctgtttttaaattttgcataaattgtttatcattgtatgctttcttcagagatctttaaaaagtcagctttatgctctggagatatattttaatggagagaggcagacaataaatatggaaataagtaaaatgtattttaaatgataataagtgctatgaagagaaaagaaagcatggaaggaagatagagagtttcagattgttgcatttaaaaagagtggccagagaagacctcataagacatcttaataaaacctaaaggcgattaaggagcgagccatgcaaatatctgggggacaggtgttctaggaggaggtccagctagtgcaaaagccttgagatgggaacatccttgtcatctggaacagcaaaggggctagtgtagtcgaatgtcttggagtaagatggaaattatcttcccttagagaaataactggaaacccagtcatgtagggccttagaaaacattatagagcttttactttggtatgggtagactttgagggttttgaacagatatgtgacttatctgacatatgtgacatgctctgacttagatttttacaggagcggtgttgtaattacgatgcaagagcagaagcaggaagaccatttaggaggctattttaatgatctaagagggagatgatggtatctggaaccatagaggccaatgtgaaggtagtgagaattggttggattccgaatatattttcaaggtagaaccaacaagaattgaaaaaactaggggactggatatagagtggatgagagagagagagagagagagagagagagagagagagagagagagagagagagagaaatagtgaaagatgaagcaggcatttggcttgaagacctgaaagcatggagttggcattagttgggatgatgaattttgtgggagaagtaggtttggtgtcaggaagaatggaaacttggttttagacacgtttaatttgaggtacatactatacagcttgtggatatgttaaataggtggctggatgtaggaatttcaggatctggacactctaattttctggtcaaagagatgaggagaaacaaccagaaaaggagactgagaatgagcagttaatgagttaggaggaaaactgggagaatatggtattctagaagccaagagcatatttcaaaggaaagagaatttgtcagaagctgctgattggtaaactaatatgaggattgagtaatggtcatggaatctggcaaaccagtgctttttgctgaacttgacaagagaagtttcagtgggtggtgaagtcttgattggcatgtgtcaaataaagatgagagaagaggaattaaagaaaagtactaacaacttttttgaggagttataaggaaaggaaagaaacagggtaacaagtggtaagggatgtgggacaagatatatatatttttaagtttggagaaataattatgtttgtaggttgacaggaaagatcaagaagatgtaagaaatgatgccaaaaataaagggaataatttgctagagggatgtactcaagaaaacaagtagcaatgggatctagtgaacaaatagagtggtaaaccttacctaggaagagcatgggcactttattcataagaacagatatgaagtcaggttatttgaatacaaatacaggtaaataagtagaggtggagagaactcttgaaaattttgtttctttttattttctcagtgaagtaggaagtagagtcatcacttgagggtgagaatgagggatagtggaagattgaggtttgaaaagagaagtatgaaatcatttaggagggagggagagtgaatgagttagggaagtgtagtaggatccttggcagaattttcccatgtgagagacccttaatgtgcgaacgcagagtctttttatattttctgccttactgtggatgcatactggaattgtccttagtttttactattatgagcaattgtagcaaaaatattcttatttagtcttctattgtttcacgacagtttgtctaagctatttacttaatagtataaatgcttgttcatgctctattttacccaactatactccagcctcatcttactaatttgcacttctaccaggggtgaatgacagttcccatttcttctcaacaatctcattaaggtttgatgttttttcatttttgaatattttttgccaatatggtgagtataaaatggtgtcctattttggttttaatttgcgtttccttaattgctaatgaggtataacatcttttcatatttattggccaaacagctactctgaaattttcacccatattgtcatatgtagttgtttgtgtacccttttttgataataattttttgttagttttatattttgccaacattttatctctcagattgtggatcatctttttactctttgtgtaatatttgataagcaaaacttattaattttaatatagcagaagttgtcagtattttatggattttgctttgtgtcttgcttaaataatacttacttaccttagtgttttcaatattgccttccacacatttagtctttaacccaactggataaggacttttgtgtgtgtgtgtgtgtgtatgtgtgtgtgcacaaccagaactataaatagtgctcccagaactatttattgaaaagtccattccattagtggtctgcaatactaacagtttttttggttagaattacttccaggtgattgatattttatatgcttttctaggtgaaatctgtattcatttcctatggctactataataaactatcatagacttggaggcttaaaacaacagaaatttagcttctcacagttctggtggctaaaagtctgaaatccaggtgtcagcagggccattccctcttgaaaggctccagggaagaatccttctagccttttccatcatttggcagctccagacattcctgggcatactttgattgtagctgcattactccagtctaactcttggacttcatatggacttctccttgtgtgtttgtatgtgtctgaacgtggccttcttgtaaggacaccagtcactggatttaggacccatacttgtttaggattagatctatgtgatctcattttaacttaactatctgcaaagaccctattttcaaactaaggtcacactccaaggttccaggtgaacaattttgggaggacagtattcattcaaccagtacaatatcttttaatttctttttctgtttatgatctgatagactgaaaggcaattgattttttattactcttatgtctaacagtttgctgtatttttgtaatttatgtgtagacttttttagcgttttttaaataatagttgatcagattatatacaaataatgacagttttgtttcttcctttctgggtcttacagctttatatttttctcgtcttacaatttctgctataatcttcagctcattgttgaatagaagtgtgataacaggcatctattttattcctgagcttttaaaaaatgctttcagtatttcttcactaagaatgatgttcattgtgggttttttagatatcattataaagaaaggtctcttttttcctggtttgataagggtttatattatgaatggatgcttggttttgccaaaggctgttttaggaatgacttacttgatttttctactaaataatttaatgtggaatattattttaatttactttattattaactcaacttgggttaaatcaaacttagtcataatgtattatgtgttttttttagtttgctagtatttttgtaaggatttttacattgatgttaatatgtgagatttgcacatgttttttttgagatattcatgtcagctctttggtggtgttacttcgggcttttaaaatgagttggggagtattctttttaatactctagaacatttatcacatgtatatatgtatatattattggaattatttttcctattttaaaataataaactttgggccaactaggtctgatgttttcttcagggtgtagagttttaactactgaattcaatataatagttgtaagaacattcagatgttctatttgttgttgagtctgttttggtaagatatatttaaaggaatttatccatgaaactgatatcttcagttaaattgttataaagatgttaatatattctctcaggatcttttagtatctgcaatatctgtagttgtgttcccttttaattatttttaatactgcatttatttatatctccctatatatctatgtattgtttttgaatggagttgcttacatgatgccctcttaagcataaatattttaaaatatatttactaaaaagcaaagatactctcttacataaggatcaaatttagaaaataacatggatagaatattataatctaacacatttaattttttcaattgtaccaatattttttacaaattataacattaaaattgctagattcgatttttttctttttcttttttttttttttttgagacagggtctcactctgttgcccatgcttgagagcagtggtacgatctcggctcactgcaacctccacttcccaggttcaagcgatcctctcactttagactcccgagtcactgggaccccagatgggtgccagcagggccgactaatttttgtatttattagggactgggttttgctatgttgccctggctggtctcgaactcctgaggtcaagccatccgcccgccttggcctcccaaagtgctgggattactggtatgagccggatttgatttcttaataagttttcatgaatgttcacatatgtgattggcctgtggttttccctttttatactctccttctcagattttgatacttttttccttactgagtttgggtatcttttcctgatccaggattacatccaggagcatgcaaacatttagttgtcatgtctttttagtctcctttaatttggaatagtcatgatctttcatttgaagtctgtgcctcgtttgggtttatctgatgtttctgcatgattagattcacattttgtatttttgttaggaataccaaaatgtcatattcttctcccatggctggtgaagttaaatttttgtgaaaaaaccttttttattgagataaaagtcataacataaacttcttaattttgatcatttaaaacagtacaatttagtggttttcagtatattcataatattgtgcaactattaccactagttccagaatatttccatcagccccaaaagaaaccccatacctgtctattctctctatctccatcttctggcaaccactaatttaatttctctctctctatggatttgtctaatctggatattttgtatgtatggaattgtacaaacatggcctcctgtgtgtggcttctttcacttattgtgattttttttttccagagttcgtctgtattataccatatatcagtgcttcattgtttttgttatgactgaataatattccattatctcaatataccatattttaaaaatctatttgtcaattaatagacatttgggttgttttcacttttgactattaagaatgaggctgctgtgaacatttctggaaaggttaacttttatatcttggtaaaagtggtatattttagttttctcaatggtaaatatactgtttttcctttttaaattactaagtgccttattgggagatactttcagattatgtaaatattttatttcttattaaacctttacataatagttttaatacccattgatgattctcactagaaagagttattagtatgatggttactaagtggttatatttcattattccttcttagtctccccagtctatatattcatttatatcagtatgaattcatgtatttttattttatttaatgttttgtaatcaattgctattctttattctggtgcttatattgtcacagatttgcctagtgagctcctttcaatcaggtgtctgtattctttagatatgtccccatcattctttgtgcactcctttaccttctgcacaaacatttgtccctgccctagtgctcgaataaatcattaccctcaaggaacctaggttccttttagtggagaatgttctttaaaaactaagattagagaactacgcatatatccatttatatcctctatatccatttatagatctgggcatgtatctgtagctctacatatctatctgtgcttaaatgctgtctgtctaaattgcataatgatgccatacagcattacagggatcatttttgccttcccctctttcacatttgtaaatctcttctgccagtgagaaacttggtttccattttatgcttcatacattacaaaatatttttgtatgtgaagtatgaggaacaagatttactttttccatttaatataccatatctggtaaatcagatgtaattttaatccccacattttttgtttgtttgttttgtttttttaacaataaactctatgttttagagcagttttagttttatggagaaatgagcagaaagtacagaatgtttccaaatactctcatctcccctatccccaggtcctctattatgtgtcttacgtgaatatggtacatttgttacagtcagtgggtcaatgttgatacattactcattaactaagtccatagtttatattaggttcacttttgtgctgtatattctatggattttcacaaatgtatagtgacatgtatctacaatgatcatttcatacagaatattttaattttcctaaaaataacctgtgatcctcttgcttatctcttcctccctccaaactcttggcaaccactgatatttttactgtctccatacttttgccttttctagaatgtcataaagctggaatcatgtagtatgtagccttttaattttggcttctttcacttagcaataagcatttaaagttcctttatgtctcttcatgacataatagcccatgtcttttattgctgaattatgttgcattgtatggaaaccatcttttgtttatccagttacctattgaagaacatcttggttgcctccaaattttgacaattatgaataaagctgctataaacatctgtgtgcagatttttgtgtggacatattttcaactcattcaggtgaccaccatggagtgcaattcctggatggtatggtaaagttatgtttagttttgtgagaaactgccaaagtggctggctgtatcatttttcattcccagcagcgatgaatgagagttcctgttgctctagatcgttgccatcttttgtcagcattttagattttagctattctaatatgtgtgtagtggtatttcactgttattttaatctgcatttccctgtgacatgtaatgtgggatatcttttaacatgcttacttgacatctatatgtcttctttggaaaggtgtctgttcagatcttttgccttttttaaaattgagcttgttttttattgagttttaagggatccttgtataatttggataccagtcctttattagctatgtgttacaaatatgttctcccagactgtggcttgttgtttcattctcataacaatgtctttcactgaggagaggtttttaattttaatagagtccaaattatgacttttttctttcatcatttatgcttttgttgctgtatctaaaatgtcatcaccaaacccaggttacctagattttctcctgcgttatcttctgggagttttatattaaataattttgcattttacatttagctctgcgatctattctgagttaatttttgtaaaagatgtaaggtctgtatctagatgattatttctgttattactactgtgatgccctgttgttccagcaatatttgtccaatagacagtcctttcattgttgaatcgttttttctattttgtcaaagatcagttgaccatatttgtatgtgtctatttctgagctctctattctgtttccttgatttatttgtctattcttttgccagtcccagggactgacttgattattgtagctttatagtaagtcccaaagccaggtgatgtcaatctttgactttgttcttcttcttcaatattgtgctggctattttaggtcttttgcctttacatataaattttagaatcagtttgataaaaatttggtaaatttattactaaaaatcttgctggaattttgatttgtattacactgaatctgcatatcaagctgggaagaactggcatattgccagtattagttttcctatctgtgttcatgtactatctctttatttatttagatttttggtttcttttattgtttgtagttttcctcataccagtcttgtacatattttgttaggtttctacctaagtatttctcttcttttggttctaatgtaaatggtattgtgtttttgttcttgttcactgctggtatataaaaaatcaattgtatattacccttgtgtcctgcaaccttgctatgctagcttattagttctagagggtttttttggttgttgttgttgttgttgttgattctttgggatttacttcgtagacagtcatatcatttgtgaaaaaataccattttatttcttccttcccaatctgtatatcttttatttcattctcttgtcttattgcagtagcaagaacttccactaaaatgttgaatagaaatggtgagatgaaacatccttgccttattccttttcttggaaggaaaacattgtttctcaccattaaatatgatgtttttatagatgtttatcaagctgaggtattttccctctattcctagtttgctgagtttttatcatgactgaatgttggattttgtcaatgctttttctccatctattgatatgatcatatgattttctttgttagcttatcgacatgatggattgaatcaattgactttgaatgttgaaccagcctagcatacttggaataagttccaccttcttcttcattatatttaaattatcttagcttaaatattgctctactagagaatattttgttccttgatccatattatttatttactgtccactagattatagtattttcttgttttgtaaagaaaaattagagactagagattattttattttattttattttattttttgtgatggagtctcactctgttacctgggctagagtgcagtggtgcgatctcagctcgctggaacctctgcctcccgggttcaagcgattctcctgccttagcctcccgagtagctgggactacaggcgcaggctaccacgcccagctaattttttgtatttttagtagagatggggtttcaccatgttggcaagcctagtctggaactcctgacatcgtgattcgcccacttcggcctcccaaagtgctgggattacaggcatgagcaccgcgcccggccggggctgtattttttcttagcctgcctctcctcctggggaaaaacttctgtgctactgctttggagttgcaggtgggtgggcttagtggcctgttcctcttagagtgacaccactactttatgtacagagcactagatggggatagtagtctctggagtcttctcaacttggctctttctggatgcaacagtctgccttaggagtgaggtgggatgaaggctattgggtccaatgttgttagcctgctggaattagtgtatagctaccaccctatgagtggcaactgggcagaggaagagcacccagacctctcatgatctttcccagaacagagcttctgtaacccagagctggagggaatgagaagtgctggtatcctgccactcctagtgagatatcgctggcctggagtgggagttgagggatgaaggagccttatgttcttggctttacttgcctggggtagaatttctatcatgctgaattggttttgtgtgtgtgaggcaggcgtgagggggttggggtaagtaattatctattgccatagactattgctgttctttttgagtaaatgtttctttatttggtgttgctcttagcaaaattttcttaggttaatggttgctttttataatttttaccaattatagttcttttcctagtgggagtgtttgtggaactcctcatgttaccattctgtaagtgagcttcatacttttttcctttttttttttttttgagacagagtctcactctgttgcccaggctggagtgcagtggtgccatcttggctcactgcaacctccgcctcccgggttcaagcaattctcctgcctcagcctcccgagtagctgggactacgggcacgtgccaccatgcccgggtaattttttgtgtttttagtagagacagggttttgccctggatcaagccaggatggtcttgatctcctgatctcgtgatccacccgccttggcctctcaaagtgctggagttacaggcgtgagacaacaccacgcctggctgagcttcatattctttagaaattaattggtattataatccatggttttggagctgctacatatactatactaactatactttacgtattagctatgtttatgtatataataattctaacttctaattgtttgtatcagggctttagagtagttatttaatatttatttatattgtcatgcacctttactacatatccattcattcagatcagttataattgtgagcatatatttataatattttctctcagaattatactttaattaaaagaacatttatattaattttaatgtttcacaagatgcattgtaattgtaatttttgattacacaaaaaatatatatctcaaatatatatatatatcttgagcaaatgtacctattcatcaatgagtgcaatctatagactccacttaggtaaggtacaaaaacagcaaatgaatttatgctgttagaatagtggtaatattcttatagttttttatgtgagtgctgattacttagttgtgttcatgttgtgaaaaatcattgagttttaggcttctgatatatgcagttttatgcatgttatacttaaataaaatcttaaaagtttattatggagtccatatgagttacacagttttaaccaaatatagtttagactaaatttactatatttaactttttacttatttggtattttaaaatgatgttttgggcctctagttttaagatggcttgtttcctatctttgtaaatgaaaaaataatttataatataaattattatgagtattaaaaattctttttgatattgtgtctcctcaaagcattttaagatgctatgagcctcaaaatatttttttttgaaatattgaagtttagaggtcatttataaattgttaaaaaatatgtttttttcccccacaattccagggaaacctctatatgcaaagtagaccctttatataacatatataaaatcagggaggtcattttatcctttgtaatacatttttaaattttattctgtaggactattttgaaagaaagtgggtttgccagataccttcattcagctgttcttatcaatggagctatgcttatttttggaggaaatacccataatgacacttccttgagtaacggtgcaaaatgtttttctgccgatttcctggcatatgacataggtatgtatctgttaggattgtacaaagtaggaaatatcagaaattttccatatagatattctcaaatacattaattgatagcatgtgtatatgtcattttagagttaagtgatagaatatgaatggaattctttctaatttcagcacagtagtattatagtaatagagccaggagaacagaagtactgagcagaagtagtggtagatacagggaatacaaaaagctagatttggatgtcctttttgaagactttttatgttgtttccctttgtgaacactatatcagtttattgtgtttgctacatattaattttgataatgggtagatatggaatactgttgaattatgtaaatttttatacatagtaggaatgtaaacattttagattttaagggataagcaaaaatatattaaacatttccgatatacttactatatataggaatctgatagaactagagaaaggaatagagatagtagagctaaagaaataagattttgagacgaaatggaaacccagatgtatctgggaaacaactatataagcatgttttcccaaagaactaaaaacagtttgcatttatacaattcacctaattttagttacgcaatataatcctatcaatttctgaatatttaagtgaatgtatttattgaaatactaaatttaggtatccagtagacccttgtagtgaaaacattgtttttctatgtatcatattatatataaaacctagctgatatttaaaatatacttatcagtacttaagagcaccttttattgagggtataaataaagtattataccaatttgaagcgattaggaaacatttttataagtaaaataaaagaataacacatttaatagatgtaagaagtatactttttctcttaaacctcataaaggcacataatctgctttggtaaattatttcaagtagaatcatgtaaagaaaactctgactattaataagcactttaatctttttactattacagttgtttcaaaggaaattcctagtagtaaagttaagcatggtttttaaatctaagtaatgaatgtcattctgtgattaatcatttgatactagtaatttgatctttttctttttgaaataataatttgaagtggtaactcctgacgaacatgggattgtctcagcttttaggaggctcatgaatcattgtttgaaattagtaaaatgggttgaatgaagtactgaatctaggctggcagtgactttatctcattgctagattgggcctgtcaatatattattgttttggctatggtgataagaccctgggcttatttttctggaagttgatgaaagttttgtttgtttgtttttcttctggggaaaaaaaatcccacaaaaagtatacattgttgttgtcattgttaaaaatccatgaagtggaattttgaacttttgcaaaaggttcttcaaggagcttccacacaatgtctgtacttcaatgaagaatttaaggttgagctattttctggctgacaaaatgggaatgtatttttatttttttcatattgttgaagattatgatatatcaagttttatgtgtcaaaaaacttaagtgaaaaaatttggagaattttgtttcagaaatagaaagatgtcagattatgatgattctaattactactatttatttaatttccttctatgtgctaggtactatgttaagtaatttatatacaaaatctttaacctaccttgtagcatggtactattatcctaatattcagaagattaaacagatgagagtaacaggaacttgccaaagccatgcaggtagtaggcggtagatctaacttttgtaactcctaaaacttgtggtagtctttctatttgactacatcatgctgattagttgggcccagtgtatgttcttaattatggcaacaaattaccttattcttagtaatgcttgtttcttaatgctgtagaaatatagaagaaaatatgagttccattttttcaagcaagttgttcagactggaggaaggaatagcatattttaaacagttttacattttaacaaaggtttttttttatcccctgtgctaacactgacaacaaaaacataaagacagttccacaattcaacataggttaaaactgttcggctttatctcatttgattatttgtaggtagttctcaaaaatgttctctaaaataatctgtttgatcctcctgggtttggagtatgaaatgttggactatttttctgggaaaaggtatttttcatattattatttatacttcaacaaatgtctttcaaaataattgttttcctcatggagtatgtttttgtggaaatagatataagcattatatagtaaaccaattaggaaacagaaaaagtgtcatgttgctagtttttcttttcactgtggtacaccaggacatttttggtgcatttatggaaggcacttaaaagcttagctgattgttttgtgttatatgatatttaaacaggaatatttgtaccatttctaattttttattgttgcaaaatgtattatttgaacattactctcacagtaaattttatacagtcaatatcgctaatctttgggtatataaccttgccttcacagttcccattctattattgcatgatggatgtagaaggcatatgctggtgattttcaatcatgctcataccttggcatcctctttggaggttggttggaaaaaaaaaataacttacgtaatcagattctttgagattggatactgggcatctatgttttttaaaagtgactaaagtgcagctgataatacagctagggtggtgaataagataggttgagtataacacatagcatgacacatttcttaatttgactgtaacatatgacatgacacatttcttaatgttctagtttgtaaatctagtttgaggtcagatttgagaatccaaaaacttaatttttttttgttattgttagtgctgttattattactttcagaaagccactatggcaccttcttcaaggttaacaagaactttctggtaaagataaccttctatttagaattcacacagaattctgaaacaagatgcaaaacaacttattgactatgtttttttcttaatcaaaaagataatagaggataacagaaacatgaaaatgtaatttcctgagttaaattatttaagaatgggtagggaataggatttgtataagaactatatcttgcagaaagcagaacagctgaaatttcaaatgagatttaacgaataatcgagttttcaaaataaattccctgaacatagtggtttacttatgacattaatttctttgtagtgattatttaaaaactaaatcagtaaaaactaaaaagtaattttttatttgggaaagtaatattttaatggtagtatataataatgtatattcttaaccattttataatacagtgaaattgcagttctgtatactcttaaaagatcacttaactggccgggcacagtggctgactcctgtaatcccaccactttgggagcctgaggcaggctgatcacctgaggtcgagagtttgagaccagcctgaccaacatggagaaaccctgtctctactaaaaatacaaaaattagctgggtgtggtggtgcatgcctgtaatcctggctactcaggaggctgaggcaggagaatcgcttgtaccctggaggtggaggtttcagtgagccgagattgcgccattgcactccagcctgcgcaacaagaccgacactccgtctcaaaaaaaaaaaaaaaaaaaaaatcacttaactaattaatgaagcctgggatacctgattttgtccaactgtttggagtgatatatatgtatacatatataatagatatagtttggtaaggcatataatttcatagcaaaatcatattcaaattaagacatctaattatttaattttttggaatactcatgcaaagttatgaaaattccaatctgcttgcttttcatgtttataattatttttattttctggaggttattttattagttcctctctctgtttatccgtatttctctatgcacttcgttaaattcttagggctctttcttgatgaaagtggtaccacttacctggccatctgaaagaaacaatttctttgtagatcaggaaaatccttagaatcatcacacatttctttcaatgaatttagccaactgtcgactgttttaagcttcattgtatcctttgctcaaggtgttctctttctttttgttgggattatatacaagaaatagtagtttaatcttttttaaaaagaggccactaaataaaagaaaaaataaccttttattttgaggaaaggatgaactaacatttatctaatgttttcaacagtgcttggcatgtcacacatgatttataatataattattgttacatctgtgtagtgtacattagtatatttaatttatagaagaagacactgtgatttaccatggttaaacccaaactcacacaggctataagatgttgtattcagaatttaaagttaagtctacattcagagtccttttgatattaacactatacaccgtgatatttatttttcctggtttaacaggaaaaaaaaggaattttagttggaaagaacttgttagtgtagtgagacattcaaaaatagtttttatcaatagatttaatcatatttctgagaggtatttgaatttcactctacctgtccccctcccgaataagttgattggaaaatagtgacctcaagatagaaaatccaggagaaagaaaaggataatggataatgaatctctctcattcttaacaagtctgtatccattttgagagactgtattgaatacaaaaattactgaataaagattaatgaaaaaaatgctctgaaaaagcagcctctttaataaatagttctgggaaaagttgacattcatttgcagcagtatgaaactagaccctcccctctaaactaaaaatggatcaaaacaataaaacaacagaaaacaggaataatccttcaagacatgggtctggagaagactttctgcaaaaggccgcaacagcacaggcaacaaaagcaaaagtaaacaaatgggatcatataaaataaaaagcttttgcaaagaaaaggacaatcaacagaatgaaaagacaacctccagaaggggagaaaatatttgcaaactattcatctgatgggggattaacatccagaatatacaaagaactaaaaaattctcaatgataaaaaaaacctcaacaaacaatccattttgcaaatgtttaacaaaaataggcaaatgatctcaacagatatttctcaaaagaagacatacaagtaaccaataatatatgacaacatgttcaacatcagtattcatcagggaaatacaaatcaaaacacaatgaagtatcatctcacgccatttaggatatctattatcaaaaagacaaaaaaataacaaatgctggtgaggatgtggaacaatggggaaatgtttttgatggaaatgtaagctagtacagccactatggagaatagtatggaggttcttcaaaaactacaaatagaactattatacgatccagcaataccaccactggatatttatccaaaggaaagaaaatcagtatattaaagagacacctgcacctccaggtttattgcagtactattcacaacatccaagatatggaaccacctaggtttccaacaagggatgaatgaatttgaaaaatgtggtatatatacatgctgaaatactattcagccataaaaagaatgaagacctatcatttgtggcaacatggatggaactggaagacattatgttaagcgaaataagccaggaacagaaagttaaacactgtatgttttcactcatatgtggaagctaaaaaaagttcatctcatagaagacaaaaatagaacagaggatactagagtctgaggagggtgggggaagtggtaggttacacagagagatttgttaaagaatacaaaattacagctagataggaggaatacattgtagtgttctataccagtgtaagatgacaatagttaactattatgtgtagtttcaaatatctagaattaggatattgaatgtttctaacacaaagaaatgataaatgttcgagatgattgatatgccagttaccctgatctgatcactatacattatatgtattgaagcatcactatatactccattaatatgtacaattatttctcagtaaaaaatgtaaaaaaggaaaaaagttttaaaaagtcttaactcttgggggaagaaggcaggacaaagaagtcatgaatgtagaataaaaattttaaaataaaatattaacacataggctccaaccatatttcaaaagtttaataaactatgatcaagtaggattcattctaggaattcaactgtgattcgttatctgggaatctataaatataatttattagttcaaaactaccaaagcaacaggacatatcattgtatgttaagacactataaaataatttcgcctactttgcctggcagacagtaaaaaactaaataaatatttatttaatgaatgccaggggacaattcctgagagaagatacgggtatgaatgagtttttttttaaactgagaatgagttaacctagagtaaattgtgcttattttagaatattaaaagaagttttgaagtagggagccaaaaaacaaaaccccagtaaagtaccatcatttcaggggcaggtgggaaaagatatttggcaacatccagaaatgtaattttctattacagaagttttgaaatggctaatataggtttttctttatattcatcttgttgtgagccttgtacatacaacctatgtgtactttctgtcttatttcaaatttgcatttaagactaacttatgaattggcattttaagtgaaacagtaaaagatttttatttttttttgagttggagtgcaatggcatgacctcggctcactgcaacttctgcctcccaagttcaagtgactcttctgcctcagcctcccaagtagctgagattacaggcgcctgccaccatctccggctaatttttgtattttttttgtatttttcagtagagacaggatttcatcatgttggccaggctggtcttgaactcctgacctcaggtgatctgcctgccttggcctcccaaagtgctgggattacatgcgtgagccaccgtgcctggccaaaagattttttaaagtgtctttacagtaatacagatatatatatatacacacacacacacgtttatatatatgtatatgtatattgtgaaaaaacatgagcatttatggaaaaattagccagtgaatttacattttccacttgcattttttaatgtataattgttaaaataaatcagtctgccttcagcttgagtttttaatgtaattatctatccctcacgtgtaaatagttttgatggtatagtaccgtttgctcaaatttgggtttgagagaacagtaactctaattttttgatcttatgtgtattgagtatatggttcataattaatatttagtaccttaaataatgagtacattatgttattttattttttatttttttaagcctgtattccagagagtgtatattatcttggtcttcattcttttcatcgtggctgttttgttggtatagaatattatttctgtaattttcatgatgtcagtaactatggaatttgctttaatttgtttggccttgaactgtttatgaagtgataataacctaagtgctccagaaatatattttcttcttggcaagaaatataaattatagtcagacagattaaaaatgtaggagactttttagtgtaagaattggtttagactacttgtaaacacattatatttatttagtattgagctttaaggcatttgatttatgcccacatatcaagctggcatatttgtgttttcttcctcttgttatctggacagcagagaattccccatatggccatagggaggggtgttgatgtaacagtggtggatgacatagggatttgagctacatacttacacagattgcttgtgccctgtgtttctgctcatacttgatcatgggtaccacttccattttatattcttagggttattggtaacagaactagctcatgattgcaaactctcaacacatagtcacttgattacccatggtcaagcattctatttttatctggacccagtggcatggcagtaatagaggtatataactttccaccacagatggtatggcctttgacatgtgtgtgaagcctgcattgtgattctttcactggggcttgccataaattccacatactactttttccaacagtgacactaccaataactatagtatgtactgggtcatatgtgcctagctgcagagttgcatgcagggtagacttcactgacagcagagctatttcctaccctggctggaaagagctggcagcctttaatgtcttccagtatatgggctgaagcagcattcctaggagtggaatatgctgcctttagaacacaaagaggcctaccagatggtttgctttcttctttgtaatgggagttgcaagatgcataattggtcttttaattcagatgagctgtctgagaatgttcttgtccactggacccctaaatattttaccaatatcaaagtctctgaatctttgtaggttttattttccatcctttgaagcatatgtcttaagaaggtctctgttgcattattcttgcccatctggcccaattagcataatgttgttaatgtagtagaacaatgtaatgttctgcaagatgtccaacaggatcaaatgtattctgactatgtatgacaaaagagggcggaattaatatcatcctaaggcaaaagtgtgaaggtatactagtttcccctccatgtgaatgcaaactatttttgatcctcttttttgatagttagcaaagaacacatttgccgactccatggccatgttaatcttctctaataaagatatacatcttgcacgacacctgcaattttagttctacttggtagtaggtgtctgctatcctttaagctttgtttagtttgccaaactgatgatttaaatggagatttgatggggtccattatcctggcattatttagattctttagggtgatactaattgcttctacccactctctctggaatgtgatagtattttaaaatttattgtattatccaggggataaaagctcccagaggcttccactgtgagaaccaaagaccaaatgtggtaggtgttgtgccatttgttaagcctgtttattccaattctatatccagcgactgaagacatgatcactgggtgagtctgtgacccagtggacccattttgagctggaccttgtccagctgttttcctattgtctcccatcattgggctaagttctgttacagttgctcctactatcagctttggtctatggaggaaagccacgaaattcttagtgatgctagtgtctctcccaccatcatattcttcatggctttggtaattggcatatcctctggccctttccatagataaaatagcctggtgggttttctggcatcacatagtgtattgacttcagcatgtgcacatttttagacttttaatcactgcctttactgtttgctatggcagttccggcattttgaccttacttagcatgggtatacttttcatgttttacatgtttctaagagtcatccagatagcaagtgaacatcacctcttgtggcatccttgtcagaaaggaaaatcctgcatcttggcagaaggctttcaaatcagtaaactctccctaatccaatcataaggttctggccaccttgatcaagctcccctctgaacctagtaccacttgtactctcccacctcctgccaacatgtgctgtctagctgtctaggtttgttgttgttgttgttgttgttttgagacagagccttgctctgatgtccaggctggagtgcagtggttcgatcttggctcactgcaacctctgtctcccgggttcaagcaattctcctgcctcagcctcctgagtagctgggactacaggcgcccgccaccacgcccggctaattttttgtacttttagtagagacgggggtttcactatgttggccaggctggtctcgaactcttgaccttgtgatctgcccgcctcgacctcccaaagtgctgggattacaggcgtgagccaccgtgaccagcgaaggtcttatagattctttggtcgtatactctctttctttccttagcagtcccagcatgtacctagatgagttatgttgatacccaacccaagttataggccctctggccagtactgaagatgtgagcagattctgccctgcgccacaggtcatgctggagagtagcctctacattgtgtttaagcaaaggcagagtgctatctgtcttttaggaaggtaggatggatcatttctgcagtgtcagatgattcaggaaaatttgggaattcaaaatttgggaagactttaaggagcatcaacttctgatattcccattttgtgtgtcagagtcctttttcttctggggcttgaccttctttaattgacagatcttctataattggcagtctcgttatatggtactgaggagaccctctggctttatcagcctttcattatctttttctagagctcactggggctaagcagtagacatgcaattctagtatcttaatagttacccttcctcatgtttttcaagcatctagtacttcactcctgctatactattcccttctattggcatgccttcctactttatcactagtttaagtttttgcagttgcttaatggccactttgtgccaagagctatctgtgctccacctaccaccaatgatgagtttttcattgctagcctggcaatgtatgatccagctctcaaactccaacttatttcttactttagtataccattcctgaaacaagtcagagtttgagtcctctggaaagcagactctgaggtagagtttagtattcatgatgttaattgggagtacccttacaatcaatgcctttgcaagaggtagggggatgatgcagaattggacaaagggagaagttgagttgtgatgctcgatggataaccttagtcaaccctgtaaggattgactgaaggcaaaataattggtcatacttctccaatgttgggctggaatggccaggcctttataccaatacattgatcagtcattcaatatgggtcattctaggaagggtgtgcccttgagtgaagtgggcctgtgttcctcaggcagtttgtgaggtagcttgcaactgactcttcactgacagcactgctagcaacccagacaacaagtttttttttgaattatgatctgggcagcatatatccatgtctaccagaaatatccaaacttcagatgattgacaccaaataaaaatttatttttcacccattatacatgttcatcattggtgggcagggcagattttttttattattattatgctttaagttctagggtacatgcgcataatgtgcaggtttgatacataggtatacatgtgccatgtcggtttgctgcacccatcagctcatcatttacattaggtatttctcctaacacccatcaactcatcatttacattaggtatttctcctaatgctatccatccccaggcccccaaccccacaacaggccccattgtgtgatgttccccctgtgtccaagtgatctcattgttcagttcccacctatgagtgagaacatatggtgtttggttttctttccttgtgatagtttgctgagaatgatggtttccagcttcatccatgtccctgcaaaggacatgaactcatccttttttatggctgcatagtattccatggtgcatatgtgccacattttcttaatccagtctatcattgatggacatatgggttggttccaagcctttgctattgtgaatagtaccgcagtaaacatatgtgtgcatgtgtctttatagtagcatgatttataatcctttgggtatatacccagtaatgggattgctgggtcaaatggtaattctagttctaaatccttgaggaatcaccacactgtcttccacaatggttgaactaatttacgcttccaccaacagtgtaaaaacattcctatttctccgcatcctctccaacatctgttgtttcctgactttttaatgattgccattctaactggtgtgagattgtatctcactgtggttttgatttgtatttctctgatgaccagtgatgatgagcattttttcatgtgtctgttggctgcataaatgtcttcttttgagaagtgtctgttcatgtcctttgcccactttttgatggggttgtttgtttttttcttgtaaatttgtttgagttctttgtagattctggatattagccctttgtcagatgggtagattgcaaaaattttctcccattctgtaggttgcctgttcactctgatggtagtttcttttgctgtgcagaagctctttagtttaattagattccatttgtcaattttggcttttgttgccattgctttggtgttttagtcatgaagtccttgcccatgcctatgtcctgaatggtattgcctaggttctcttctagggtttttatggttttaggtctaacatttaagtctttaatccatcttgaattaatttttgtataaggtgtaaggaagggatccagtttcagctttctacatatggctagccagttttcccagcaccatttattaaatagggaatcctttccccttttcttgtttttgtcaggtttgtcaaagatcagatgtttgtagatgtgtagtattatttctgagggctctgttctgttccattggtctatatctctgttttggtaccagtaccatgctgttttggttactgtagccttgtagtatagtttgaagtcaggtggcatgatcctccagctttgttcttttggcttaggattttcttggcaatgcggactcttttttggttccatatgaactttaaagtagttttttccaattctgtgaagaaagtcattggtagcttgatggggatggcattgaatctataaattacctttggcagtatggccattttcacgatactgattcttcctatccatgaacatggaatattcttccatttgtttgtgtcctcttttatttcgttgagctgtggtttgtagttctccttgaagagaactccttcacatcccttgtaagttggcttcctaggtattttattctctttgtggcaatggcgaatgggagttcactcatgatttgactctctgtttgtctgttaatggtgtataggaatgtttgtgatttttgcacattgattttgtatcctgagactttgctaaagttgtttatcagcttaaggagattttgggctgagatgatggggttttctaaatatgcaatcatgtcatctgcaaacagggacaatttgacttcctcatttcctaattgaataccctttatttctttctcttgcttgattgccctggccagaacttgcaacactatgttgaagaggagtggtgagagagggcatccctgtcttgtgccagttttcaaagggaatgcttccaggttttgcccattcagtatgatactggctgtgggtttttcataaatagctcttattattttgagataccttccatcaatacctaatttattgagagtttttagcctgaagggctgttgaattttgtcgaaggcctttttggcatctactgagataatcatatgattttgtcattggttctgtttatgttatggattatgtttattgatttgcgtatgttgaaccagccttgcatcccagggataaagctgacttgatcgtggtggataagctttttgatgtgctgatggatttggtttgccagtattttattgaggattttcacatcgatgttcatcagggatattggtctaaaattctctttttttgttgtgtctctaccaggctttggtatcaggatgatgctggcctcataaaatgagttagggaggattccctctttttctattgattgggatagtttcagaaggaatggtaccagctcctctttgtacctctggtagaattcagctgtgaatccatctggtcctggactttttttgtttggtaggctattaattattgcctcaatttcagagcctgttattggtctattcagagattcaacttcttcctggtttagtctcgggagggtgtatgtgtccaggaatttatccatttcttttagattttctagtttatttgcatagaggtgtttatagtattctctgatggtagtttgtatttctttgggatctgtggtgatatcccctttatcatttttattgcatgtatttgattcttctctcttttcttctttattagtcttgctagtggtctatcaattttgttaatcttttcaaaaaaccagctctgggattcattgagtttttgaagggttatttgtgtctctgtctctttcacttctgctctgatcttagttatttcttgccttccgctagctttttgaatgtgtttgctcttgcttctctagttctcttatttgtgatgttgggtgtcgattttagatctttcctgccttctcttgtgggcatttagtgctataaatttccctctacacactgctttgaatgtgtcccagagattctggtatattgtgtctttgttcttattggtttcaaagaacatctttctgccttcatttagttatttacctggtagtcattcaggagcaagttcagtttccatatagttgtgcggttttgagtgagtttcttaatcttgagttctaatttgattgctctgtgttctgagagacagtttttttgtgatttctgttcttttacatttgctgagtactgctttatttctaattatgtggtcaactttagaataagtgcgatgtggtgctgagaagaatgtatattctgttgatttggggtggagagttctgtagatgtcttttaggtttgcttgttgcagagctgagttcaagtcctggatatccttgttaacctctctcattgatctctctaatgttgacagtggggttttaaagtctcccattattattgtgtgggagtctaagtctctttgtaggtctccaagggcttgctttatcaatctgggtgctcctgtattgggtgcatatatatttatcatagttagctcttcttgttaaattgatccctttaccattatgtattggccttctttgtctcttttgatctttgttggtttaaagtctgttttatcagagactaggattgcaatccctacttttttttgctttccatttgcttggtagatcttcctccatccctttattttgagcctatgtgcatctttgcacgtgagatgtgtctcctgaatacagcacactgatggatcttgactttgtcttttaattggggcatttagcccatttccatttaaggttaatattgttatgtgtgaatttgatcctgtcattatgatgttcgctggttattttgcctgttaattgatgcagtttctttgtagcatctatggtctttgtaatttggcatgtttttgcaatggctagtcccgtttgtttctttccatgtttagtgcttccttcaggagctcttgtaaggcaggcctgatggtgacaaaatctctcagcatttgcttgtctgtaaaggattttatttctccttcacttatgaaggttagtttggctggatatgaaattctgggttgaaaattcttttctttaagaatgttgaattttggcccttagtctcttctggcttgtagggtttctgccgagagatctgctgttcgtttgatgggcttccctttgtgggtaacttgacctttctctctggctgtccttaacactttttccatcatctcaaccttggtgaatccaacaattatgtgtcttggggttgctcttcttgaggagtatctttgtggtgttctctgtatttcctgaatctgaatgttggcctgccttgctaggttggaaaagttctcctggataatatcctgcagagtgttttccaacttggttccattctccccatcactttcaggtacaccaatcaatcaaatgtagatttggtcttttcacatagtcccatatttcttggaggctttgttcatttctttttagtctgttttttcttactttttcttctcgctttatttcattaatttgatcttcagtcactgataccctttcttctacttgattgaatcagctattgaaacttgtgcatgcgtcatgaagttctcctgtcatggttttcagctccatcaggtcatttaaggtcttctctacactgtttatcctagttagccattcgtctaatctttttttcaaggtttttagcttccttgcaatgggttcgaacatcctcctttagctcggagaattttgttattacctaccttctgaagcctacttctgttaacttgtcaaagtcattctccatccagctttgttccattgctggtgaggagctgtgatcctttggaggagaagaggcactccaatttttagaattttcaccttttctgctctggtttctccccatctttgtggttttatctacctttggtctttgattttggtgacctacagatggggttttggtctagatgaccttttgttgatgttgctgctattcttttctgtttgttagtttttcttctaacagtcaggtccctcagctgcaagtctgttggagtttgctggaggttcactccggaccctgtttgcctgggtatcaccagcggaggctgcagaacagcaagtattactgcctgatcctccctctggaagcttcatcccaacggggcagccacctgtatgaggtgtcggtcagcccctactgagaggtttctgccagttaggctacacgggggtcagggacccacttgaggaggcagtctgtttgttctcagagctcaaacgccatgctgggagaaccactgccctcttcagagctgtcagacagggacttttaagtctgcagaagttgtctgctgccttttgtttagctatgccctggccacagaggtggagtctagagacggtaggccttggtgagctgtggtaggctctgtccagtttaagcttcctggccgctttgtttacctagtcaagcctcagcaatggcggatgcaccccccagccaggccgctgcctcgcagttcaatctcagactgccgtgctagcagtgagcaaggctctgtgggtgtggtacctaccaagccaggcactggagagaatctccttgtctgctgattgctaaaactttgggaaaagcgcagtatttgggtgggagtgtcccgtttttccaggtagtctgtcacagcttcccttggctaggaaagggaaatcccccaaccccttgtgcttcccgggtgaggtgatgccccaccctgcttcggctcgccctctgtgggctgcatccactatccaactagtcccaatgagatgaaccaggtacctcagttggaaatgcagaaatcacccatcctctgcgtcgatcacactgggagctgcagactggagctgttcctattcggccatcttggaacgcctctccagatttttttttgtcattatttagggacccaggctgacagaagacataggctttcattgctaatcaaatgcctccaaccagaaacacagatattccagtagcttgcattacattgatacattcaacttctagggattgtaagagtataattttgtgccagaaggaaaggaactgaaatattttattgaacagcacaaatgtctatcaaaagtattgtatgtaattcttttttaaacttttagtataattgaagattgaagatgatgtcttggagatagtaataaagctgtcacttcctaccgctacatgtattgaaaggcaaataacttctagaagtagaattatgttttattattatttgcctaaattaattgccttcatgtataattacattactattactgtactgtaatgtttctcttctgcaggacttgtgtactttaaaaacaaaacaaaagaaaaccagaacatgactgagagcataagcactattttgtaaacagtgggattaaatgaaagtatacatacttaagagtgaaaccctctagctaccctttatccacttagggtcttcctaaaatgctgttagtccgatttatggtttccaggcaggagactggaaaattatctgaagaaatctgaccagcctaagagaaagcatgtagagatactgacatttggaggtctctaactgaaatggttccacctgatcagaatcccagaggtcaacatgtccttcttaagcactaaattcctaatgactctggtggtgcctcactcttaaatttgcagcctgttattattttgacaattacaaaaagttactaaatttgatcaaaatgtcaaacgagtaggaaaaaataagaaattaggggaaataaagataatccacagaggagattataagttaaatctttatggacagaagatgttacatttgtgaagcaaaatgtgagattttaataaaaatagttaattcagaaaagaaaaaaatgagctcttggaaattaaaattaggaaaacaaatcaatgatttgaagataaagtgaagaatctccataaagtattatgaataatggacaaatggaaaatagggtaaaaaatgagaaatttaatatgactgttccagaaaactttgtatctcagtaatagaattgaaaaagcaaagaacataacattttagacaggaaggaaattatcaagtgagtaattcaaaaatatgtttgggattgaagtacacaaattttaagactaaaagagcctactgagccccagaaaaataaatacaaaagactcacagcaaagctcattacaaaaagacaaaaagaacctaaaaacttatatagagagaaaagaaataggacaaataaatcatgagacttgatagcatagtgccttacaaaagcaatacgagaagccagaagagtggactaataccttcaatatctgaaaatgctttccatgttagaattctaacaccaatcaaatcatactaaaagtgttagagtgaaataaaattattttttagaattgcagattctcaaaaatatacctccaatgtacactttatttagatactttaggattatatctcctattgaagtatgagattaaataaacagatgaaatctaagaaatggaatatataacaggggagaaatatggagggaatccttatgatgatgtaataggcctagagagcagtaagttcagattggagaagaaagatggagtttcaggagggatgtctttacaaagtaaatgaaattgccagatatcttgatgtattagaagatattgagaagaaatgtacacatctggcaaagggttgggggagaaatagcagtagatatacagaaaggtaagcaaaaaagtgaaaatataatttgtggagaaagtaagttatttaagaataaaaatgtagtatgctacctggcttatctgtgaataatatcacagatatatactatcaaagataataaaaactgaacattagctgagtgtggtggtgtgcacctataattccagaaactctggaggctgaggcaggaggattgcttgagcccaggaattaatttagtccagcctaggcaatacagcctaggcaatatagcaattccccatctctaaaaaacaaataagaaactgaatattgctctaaacaaaattataatataaatgtatagagaatggagggagaggaaatatgcgtgtgtaagtctgtgtaagagcttaatcttcaccatctgaagaaggaagtcaggcatattatctgaaactgggaactaggcatgctgtttagaacagatgaaaatacaagaaacaaaaacaaaaacaaactctttatagctgtttatttagaattaaaagtgcttacctccatgattctggaatatgctttgggaagatagggggcagtggatttttttttttttttgataaaccttgtagaaatattggacttttgggcctcacacatgtatatatttaaaaatgataaaataaaagcaaagtataacagtacagaaattaaatgatgcacaagttagtggatcaaggataaatgttcaaaaattgggaaaattagtgcattgacatatacttggaaatatctggaaaatatgatatatgggaaaaattaagtttgatgcttaccagatatacaaaaataagttgcaaaaagattgaagaccaaaatagtaaaagccaacagaaaaacctttactggaaaattagagattatttttaaaatctcagtttactgagtaaacaagcacagatcataaggtgacctaaaggtaagaccaactttctgtaaaacaaggtttcataaactaagtgaaaaaaagatgctgtagcatggaagaatatatggtaatacatatagccagcaaaggattagtatccagaatatttaatcaagaatcctttaaattattaagaaaaagacaaaaagcaaatagaaaaatgtgcaagtcttaaacagtgatttcatagaagactaaaacaaataacctatacatgtgaaaataagttgactcaccagtaactggaaaaatgtaaaatcaaaccattcatcagattggtaaaaattttaagtctgatagaactacatgttgtagagaatataaaacaagaggaactgttgtacactgctaatgtgagtcaacacaactactttggggagcaaattgggaaaatctagtaaaatcgaagttgtgtcttttcttatacctcttggaaatctagagaaacattcaaaatatgcacaagatacatataagagtgaatataccaacatgacttgtaataggaaaaaaatctttaaaaaggctaattattaacagcttaatgggtaaatattttgtgtagtcataacatggaaaactctaacatggttacaatgagcacacagtaccacttgtatctataaatttaaatgagctgttgaattgacatttctccaaagatatacaaatgtccaataagcacatgaaaagatgctcaacatcactaatcattagggaatgcaagtcaaaaccacaatgatatactaattcatactcattaggatggctatgataaaaaaacagaagataacaagggttgacgaggatgtggagacatatgaacccttttgcattactggtaaaaatgtaaaatggtccagctactatggaaaacagaatggcagtttcttaaaaaattgaacacagaattactatatgatctgttaatcaaatggacctcatacaagttatttaccttcatgtaggtctgattcttcatttctaacatagggtaatacctgctccatcaatttcactggattcttataaagaccattttaagatatgcgatgaaaacactttggaacttttatgtgtacttaatttataaaagtatacagtttatactttatataatttcttttgcaccaacctaatagtgctacaaacatataatgtacatttattaaattaactctaacatgtaaaattggcagtcttaatctttatcataggcctccataataatattttctaaaatgtgatcttcagagcattgactcttgaggatcttaataggcattatgtgaaaagtgcttctttggataaaacattgggaaaacactgtgttaaataaagttaggttaggtttctgtacctttacactctctcttttgagaatatttaataggcagatataccatgtggactaaaaagacagattatacactttttcgggggagatttgtgtttcctggattatactttagcatatacaggtcaacatatattttattgttctcagtctttcagcatcattctctttttttttttaattatactttaagttctagggttcatgtgcacaacgtgcacgtttgttacgtatgtatacatgtgccatgttggtgttcagcatcattttctaaacttacagttttggtttttataattttttgatgttcattaataaaatattgagttgaaaccaaatttattttattattgttatagatgtaattacttaaataagaaaacaagtaattcattactttaacttttacaactaactgtacttaagattattttcttgttccataaaggcttttacctaaacaaaattaatttgttttaaaaaatcttgtatctatatgctttcatgaaataccaaagcatgcctttataaatatgacatttctaagaagttgaaatctaaaacactgtattgagaatgttcctagtcactgaatgatgaattattttaaatctcaaatttacgttagtatatatgtcagttctgagtttatattgaaataatacacatttttcttaaccactttccatagtttctatatagttcatagattatttatgattttcattttttatctagaagttttgcagttaaaataattcccttctatataaaaaagcttttttgagaattcaaatcattaaagtgatttaaatgttttatcctgatgattatatttttaggtattctttcagtgaacattgtatctgccattgacttttgtatgcatacatgtcatatttgatttagtatttaactttcaaagaggtgtgccctatactgacattcataagttttacttggaatatttaataaatatatgtcttcgaaattatcttccaatataaaatacctctaagttcattcttttcattttcttgttctcatatgcttaaaattatttgtgagaattctaggcaagagttatttttatttaatgaataatgttagttgagtaaatacactaaattgtaggtcatggaaaattaatgagaatttttttttgcttcctgcttatgcatagtgtatctttaattcggccaatgatgttttcatattatttgtcttagtttattcttttatttcattttttgtttttctgttttcttttttctagcttgtgatgaatggaaaatactaccaaaaccaaatcttcatagagatgtcaacagatttggacactctgcagtagtcattaacgggtaaaagaagcacatttccaatttttagagggtcacttatatcagtcatactatcctcatattctggtattctttttgaaaattatcattggtacttaatggtattggattttatgcatctcttctctaccatagaatgcattttgatttgtcaatcatatctttttttcctttcttgtttaatatatttaagggacatgggagtaggtaaaggaaaggtgctgagataagacatcagatacccttttatgtcatcctgccttcttttctttttccagagatcagataaggaatgactcttcttttaaaaagatggaactgaaatgatagagaggctagccccatatttctatcaaggagaacaaggaaagtgagaagaattagattctcattttagttctgtcatttactaaatgtgtgatttttgacaagtctcttaacctctctggaccttaaaatcattatatccattgagaaattggactcaatggtcattacattgccttccccatttaagttaatataatttttgtatttctatggcaaaaatttggtaatttggaatccagtgacagtaaacaatctgctagctcatttagtggcttaacatttgtaaatcagaatgacctttttataagcccattttattaccaccttatcctaaatatgtaaaaattctccactattgccacaaaatgacttaaccacaatgaaactgtgtaactgatatcaagtggctgtccaaacagtaatacatgaaaactgtgaaacataaaacctccagggttctctggttgatttttattttacttttttaaaataataaaagacattcttgaagacttttttgactgattcaatttattatgttaataatatttttgacatgaaaaatatgctgttttaagggcattggcactgcttggtattaatttagtattgtctaggcttctctttccagactgaatttaaaaaatctttttgattattttactcttagttttcttattttaaaagaatgaaacaccataagaagaactcggtatctaatttcaaaattctgtgtctatattgaaaagttataattctagatagcagttctaaagtgtgtcttgtccatgtatagctattatctatttttttaaaacattgttttctatattattaaaaaaatacttatttttctgacaaaggaatattgtatataatcattgtttcttttcctttcttgtattaacaataaaacatgttttgaagacttagtgttttcttaatatattaagatttatagaatatttcatattttgtctggaaagtcttcaagaaattatatagtagttcctctggtgtttttatatcatattgtatgctagaaatatgattttaaagaacagtactaacagaagtacttaaaatagtataaaatgtatatttaaatctatgcttatttttataactaaatcagtagatagggacttttaatagcgtttctttaagattcttgttttgtttttaataggtccatgtatatatttgggggattttctagtgtactccttaatgatatccttgtatacaagcctccaaattgcaaggctttcagagatgaagaactttgtaaaaatgctggtccagggataaaatgtgtttggaataaaaatcactgtgaatcttgggaatctgggaatactaataatattcttagagcaaagtgccctcctaaaacaggtaaatttctttttcttttcgtctttgtggcagcaaaatttctcttctacagaagtagaaatatcttctgcttataagaattactttagtagctacagaaatgaaaaatttgtattaccctaattaggaattctaatgtttgaacctagtgattaataatttaatacatttattagctatttttagctttatttttgaaatctgtatatatagtatatatatcaatattttatatataacattgtcatatatatgaattattttctaatataagtttaaaatgctttccagtacatcatttctaagaagtgctgttagattcaaagaaataaaatgaaataatttattttccatgtggtatttttttttcttcctgaattattgccaaaccacaccataaagtaaaaaaatgttacagcatttcatgactaatgatctggttttatatttcttataaaatggtgaataaataaatgagacttatgaaaagttaccagtcaattattaatcagttagctaattaattatttggataaatattgtttagttttttaagtgctgagagtttttatacatttttgcggttacaattaataaatgtatttttaagttttactaatctatattaattcagatgtcttttatatctttagaaaggatgataaacagtatttgttatgatgttttcttttgtatgtatagtaatacactttgttcagtaaaatatatgtaaatcctttgactttctctaaaatacgtaaatttatttattttagtttattttttgagacagagtctcactctgtcacccaggctggagtgcagtggtgtgatcaaactctgtctcctggtttcaagcaattctgctgccttagctttccgagtagctggaattacaggcatgtgccactatgcctggctaatttttgtatttttagtagagatgggttttgtgatgttggccaggcttgtcttgaactcctgacctcaagtgatccgtctaccttggcttttaaaagttctgggattgcaggcatgagctaccgtgcctggcccaaaatgtgtgaatttaaaatgtctgtaggatccttgtatattgaataattaaaatgggggtaaaaggtcttgaaaatcctgtaaacacaattgaactacaaaagttgtcttaatctttagaaaacttactttgaaattgaaggtcatttctttggttaaaaaatgtcttagtgattcttaatgattcttaaatagatattgtaaattaagaagagtaagattttcttttccgtgctgatatatcgtcccccatttgtattatagctgcttctgatgacagatgttacagatatgcagattgtgccagctgtactgccaatacaaatgggtgccaatggtgtgatgacaagaaatgcatttcggcaaatagtaactgcagtatggttagtatttatgggtaaatggtgctgtagttacaacagactgctgctttatgatcattagcttaccatttagtagcactgtagaaaaaaagcactttacacattaagacatttagaaagtatatagggaatcattcacttcttggcaaattgtgaagttagattggtttgttgttcaaatttgtcagtctagattccattttggatccatcaactttacttcttttcatggatgagactgggaacattttttcaaaactgatattgaaaaagactatagctataaatgttgtcttctgttcctatgaaaataagattatataggtaggtattgaaataatttccattggattcctgtcagacatgcattagtggtcgtgtggtctagtgctttgttttcacactttgtgtgtaagtttaacctgagtttttggtagttgtagtttctcttttaactgtctatacattagtggttctcaagttgaggcaattttgtctcacaggggacattttgcagagacattttggttgtcacaaatgtggagctgctattggcatctaataggtagaagcaagggagctgctaaacattctacagtttgataagattttttaacgtcctttttcatctaaagtagagttttagcactattgacattttgagccctataattatttgtttatttgtttatttgttgtgggagggctgttctatatattgcagaataaaaaaacataaaatatttatggcagatgaaaatgggttaagagaagcaaaaattaagattttaagtggtagcatctaaacattctatgttatgtagaagatatcaacaaattgaagggaaaaattttaaaaagtagtatttagtagaattaaagatttttttgttttgttttgtttttttgagacagagtctcactccatcacccaggctggaatgcagtggcatgatctcggttcactgcaacctccacctcctgggttcaagtgattcttctgcctcagcctcctgagtagctgggattataggcaggcaccaccatgcctagctaatttttatattttagtagagacagggtttcaccatgttggccaggctggtcttgaactcctggcctcaagtgatgtgcccacctcagcctcccaaagtgctgggattacaggcatgaggcactgcacccagcccaaagattctttcatgggcctatagcttgagtaaaaataaatagcatggatacatatttccaactgaatataatgtatcattttttcttttttggaaattttattactgaaagtatctacttgtttttcaagatagcaggcagaggtaaaaggcaaagaaaagggagttgaaactaagtaaaaaatttgattgtataattaaaaaaattcttcactaattaataattcaaaatatgtaagttttatgactttaatctaattttcagaacttaaaatggagggaaatttgcagttactgactcattagattgaacccttttgttttcatacatactctgttgttatatactttccagtgatacaagttgttttaataacaagatatacttcaattttatttgagttttaacattaatataacatggttatgctttgaaaatttaaattacgtttgaagatatccactgatattcatctaatgggagttattttagtagaagtcggagttaaataaaataagacatgggaatcagggacttgtattacagttcttcagagaaacagaatctgtctatatatatatatacacacatacacagtttatatatataaataaataatatatatttgtttatatattatatataaatatataaacatttgtttatatatttgtttatatattatatataaatatatttgtttatatattatatacagatatataaacaaatatataaatcttttatatataatatataaatctattatataatatataaatatctgtatattatatataaatatataatatatatttgtttatatataatctataatatatgtgtatatatatatataaaatgagatttattataagaaattggctcatgtggttatgaaggatgaaaagtcccaggatctgccgtctgcaaactgaagacccaggaaagttgatgatgtaaattctactctacgtatggaggcttgagaaccaggagtgcagatggtgtaagtctcagtccaagagcaagaaaaggcagagagaggaaattctttcttcctctacttttttgttctttcaggccctcaattgcttggatgacgcccaccatagggagagcattttactttacttggtttaccaattcagtctcatccagaactgccccctacagacatatccagaaataatgcttagcctaatatgtgtccaccccatgtcttggaaaagttgacacataaaattaaccattacaagtctaccccttgtcaacttggcacctatacatatctacataaaccatacttaattttcaaatgaagataataacaaggtcataattctacctaacataatacaagtatcctgtgtacaactggaaaacacatcaatctctttcccagaaaaggaggtaaagtcctggagtgatatttactcctctccttgatattctgtaaattaaatactatgatgtaaaatcaacagtacttaaattctgatatgagcatcttatgttacatgatgagggaataagagaagaaagaaaacaaagatattacacacacacacacacacacacacacacacacacacacagatgtattcttagcaaaatgaggaggaaatacagtccttatttctgtaagtgatcatgtggttgtagctaatatttatacatatattcttttttttattatactttaagttctagggtacatgggcacaatgtgcaggtttgttacatatgtatacatgtgccatgttggtgtgctgcactcattaattcgtcatttacgttaggtatatctcctaatgctatccctcccctctacccccaccccacgacaggccccggcaattcctcaacgatctagaactagaaataccatttgacccagccatcccgttactggatatatacccaaaggattgtaaatcatgctgctataaagacaaatgcacacgtatgtttattgcagcactgttcacaatagcaaagacttggaaccaacccagatatccatcaatgatagactggattatacatatattctcacctaaccattttgtatttcctttaccttcagcaagcaccttacctgcttgtagttttttatctgttggggtgactcaaacctttattcttgaagggtcattcttcattagtagtcctgcttgaattggattgttgtagttttccattgatcttaatcacagggtaatataatttggacatttgtccctgcccaaatttctgttgaaatataatccccggtcttggaggtggggcttggtaggaggtgtttgaatcacaggagtggatccctcatgaatggcttgggccacccgcttgttgatacgtgagctcttgctctgggttcacttgaggtctggtcgtttaaaagtatgtggcaactccacctccattctcactcttgctcctattctgccatgtgagatgcttactgccactttgccttctgcaatgagtaaaagttccctgaggcctctgcagaagcagagcagatgctggtgccacatttcctgtaaagcttgcagaactgtgaactaactaaacctcgtttctttatgaattacctgatttcaagtattcctttatagcattgcaagaatggcccaacacacagggtgtagggtatggtaatactgaaagacgccataagggatctcttgtattctagacatattcttcctagcctcctgtgtgaagtggcagttcagtttccctgtactagaagcagtcaccccaatgagcacagtaactcttctttgactgatgatttagaggtgtaaggaacccaaagtggccaagtggcagtcttaatttccaattctatggaatcagtgttgtgttttctggaaaaaattattccttcctctggaattaagacatctaggtcagcaaagaataaggtcacaggaataggaagaaaaatttcgctaatgaattactaagggcagtagtgagtagtaccactcccatttccaccccttgattattggacccataaatgctggctgtgagagaaaaagcaccatatattggatgctgactcagagcttatatggctttctggagaacccttctgtcagccttgcaaggtattactacgtagctggcactgtaactgaatcatcaaaagcccattccactgttttatgaaacgagttgcttgacaattgtagggaacatgataagaccagtgagcataggcccattgctgtcctccatgtgctgtgacatgagttccttggtcaaaagcaattctgtatggaataccaagatagtagagaaagaattctgtaagtttactgatggcagttatggcagaagcattgtgagcgaggaaggcaaatctatagccagaataaatgtctgtttcagtaaaaacaaaatgcttccctttccctgattgaagctgtatcaaccttcctccaggtagctggctgattacctagggggatggcaccatatcaggagctcagtgttggtttctgctactggcatattgggtactcagcagtggtcatagccaggttggcctcggtggatggaagtccattttgctgagcccatgcataatctccatccctgccaccatggccactttgtccatgagcccgttgggtaatgacacaggtggctagggaagaaggtatccacagaagtggtcatcttatccatgtgattattaaaatactcttttgctgatgtcacgttttggtaaacatttacgctggatacaagtatcttcacttatttgccattcagtgagatctgtccgcatcccttttccacaatttttttttttgtcaccaattttccattcatgttccttccaagttcctgaccatacagacaaaccattggccacagcccatgaatccatacataattgcacatctggccatttcttcttccaaacagaataaacattgagaagcactgtttgattttgcccactggaaagatttcctttcactactgtacttcagggaggtcccaggaagggatagcagaacttcagcagtccttttttgggtggtacctgcatattgtgcagaaccatctgtaaatgaaaccagtcttctcttcctctgtcaagtgatctagggaacttctcttgaagtgataggtcagactgggagagagaaggcagtgtggcagaagtggggatcatgggcatttgggcctcttcatgtaacgtagttgctccttcagggcctccttgagcctgatcatgtatataccacttttatttgatgatagagtgccgctgtgcatacccaacctcatgggttggtgggtcagataacacccagttcatgatgggctgaaatcacataatttggtgacccatggttaaacattcagtttctattaaggcccagtagcagactaagagctgtttctgctaaaggatagtagttatctgcagaggatggtgatgttttgctacaaaatcctaagggtctgcactattatttgcctataggggcctgccaaaggctccaaacagcatcctgtctgccactgatatttcacgtaccattgcacctgcaggatcatgtagcccaactggcagagcttgtatagtactctggacctgttgcagagccctctcttattctgagatctacttggaattcgcagctttttagatcacttggtaaatgggtcaaagtaacataccccagtgaggaatgtgttacctccaaaatccaaagaggcctattagacattctccctcttttttgttttggttataggaggggccagaggcaacaacttaacattcacctttgaaagggatatcttgacatgccccatactgctagacccctagagatttcagtgagttagaaggcccctgaattttagatgaatttatttcccaacctctgacaccaaatatcttgccagtaagtctagagtagttgctacatcttgctcactaggtccaatctatgtgatgttatcaatattatggatcagtgtgatgtcttgtggaataaaaaggcagttaaattcctcagaactaagttattaaataggagtggagagttggtatactcctgaggtagaacagtgaaggtgtattgctaccattgccagctgaaaacaaactgcttctggtgatctttactaacaaatttcaagaaagaagcatttgccagatgtttagctgcttgccagtttccagggaatgtgttaattgcccaagcaatgaaaccacatctgataaggcaattacaattggtattaccactcggttaagcttatgataattcactgttattctccaaaatccatctgtcttctgcatagactaaataggcaaatttcatgggaatatggtgggaattaccactcctgcatcctttaagtccttgattgtggcactaatctttgcaatccctccaggaatggagtattgcttttggcttaccatttttctacatagaggctgttctagtggcttcttcttggcttttcgctccgtaattgtcctcactccacaggtcaaggaaccggtgtgagttttctttcagctgctgagtatgtctattccaattatgcattctggaactgggaaaatagccacaggatgggtttgggacccagtgggcccactgtgagagggacctgaactccactgatcatctggcagtcataagcctctgactggtggcccacagtgatgttttgggtctcctggaattaatgtcagtttagaaccagcatctggtactgatactgattatttccctttccccagtgcatagctaggatttagtaggatttctatatattttactcctaggagcaacttcatgctcaactcaccaatgccatagatgtaagcaagtcagactattccaattgctgctttaactctgctgttcatcatagtaacctcacccaccttgcctttgttagttgagtgctgctacctagcccctgccaacctagatccaattattcctgttgcatttatgtttcccaattcagtggctgcacttcccactgcaaggctgggcatacagaaaacagcaatcatggagctcttcaaggatgccagtgctcccctcccaagtttattcctttcaatactggtgaaaggtgtgtcttctggaccctctcagtgagggtgagcagatcttaaaggacaaatccactctaacattccaatctccctaagccattaaatgtcttctatattaaaccaaggcagatccagcatttccaagtcactcactgtgggccaccttttggtctatgttttagccaactaacagaaagagccctttctaactctccaagctataacatcaaatgtataatttctgcttagtgagcccatatcaataaattttgcctgatccaactttatgtttcgtctatcattttccaatacttttaccgttctggaggctgggaagtccaagatcttggtggtagtagatttggtatctggtgacggcctactttctggttcacagtagatgtcttttcactgcttcctcccctggtagaaggggagctcttgtgtcttcaaccccttataatggtgttaatcccatatatgaggactccaccattatgattaaattacgtcccaaaagttgcacctcctaataacatcacattgggattgggtttcaaaatatgaattttgggagatgcaaacattcagtccatgacagacatttacatatgaaaatacaacatatctgagtgaaaacagacatatcttaaaaattgtattatgtaaattgctatcaagtatttataaagtggcattttgctttatattttattcaatgatgatgtgttaacaaggaaaacattgggtgagatagtgtaagagagcagatggtactcacttgtaatttagaatttgatgtaatgtgtcctttagacagttttatcagaatgtcttgtgattaagctaaaccaaatgttaatggcaaagagaggtctttgggatttcagtctagattatgtacattgatatcctatttcatataggtcaaacaatgtgctttattctcacatattttcatttacaatttacatgtcagtatattagagtgaagatcagtagagtagtggttactattcataagcgtgtctggttcattaggccaaaaatgccagctatgtttcagaataatagctttcttttaccattgattaacttggctctatgtgtgattgaaatataatttcattttttgtacttgtttagtatcaataaatgactatatttttcttaatgaagagcagtagagttatttggatggagactctgttaccattgttattctaaagattgacataaaactattattctttttcttattccaacatgtttagccattctcatgtcatttttataggttattttatttatctgatacttcaggtaaatttaattatttttagttagctatcaaatgtttagaactatactgtaatgattatatagaataatgctaatatttatatactatatgaaaacaaaaaattatgaatcagaacaaataacaataagaaagtatgtttctaatgaaaatgaagtggttgaaaaagtcataaaatgatttcaaatttacaaaaatgtatcttctgtaattttttaggatgaataaagataaaaattatatctgggtactttttatctgctactttacagtaagtgtaaaatgctctaatagaaattaacacctttggaatggaggtgatggcaatgtattttatgaaggaagtggcttataaataaatacttggtgagtgacatttaaagtctctaagtggttaaaaattgcttcaataaattttatctataggatagctataacttaattttaactcttaactttattgagtgaaaacaaatatttagctccattacatgagaaggcctgaggtatttatacctatagtcaaaacaaaacaaaaagattgaggtgggggctcaatgtttagcattaaatctttgtatttttttttcttataaagtagagccacaggaaaagctgagccaaaaattttaatatctatttttcatgagttaggttttatcataggtattgataatatgtgaattatctgaacctgggtatatgtaaggaaccaccatcaaagtttctatattgtctactttttttctttattggaaattaacttttaatctctcaatgccagattagttgaaatatgattacattatgtagatttggaaacaaaataaaacttttgcagattctttgaagcctcaatggaggaaatgtgacagatatatacagaagaaatctcaatcaaccagaaccattatttagtgtctgtggaagtaaaattagtttgagttgtgacagtcatttatctttttatattgtattgggttttgataaagcatctttttaccttttactacttttcatttctgcctcattcccaggggtctgcatgatacttttattaagactagaaccattttatgtcatcattaatggaaatgactttgtacatgactttattttttgaattggaaggctgttttcgaattcactggaaaaagttttcattagatggtgcctgtttaaaattatgtaatttgcacacttcattttttaataaacattcattccaattccaagaacaatagtttaacttgttaaaagaaaaacttgggacaaaataaatttagcagagcttatttgaacaaagattgattcatgaattgagcagcattctgaaccaagagcttcggacacctccagctatcaatgtgagcaggaagtatttttagacagaaaaaggaagtgacgtttaggaacatcttgattggctacaggtcaccatttgccctatttgggcatggtgtgatgaggcatttaccttgtatggaaatagtctgatcagttggcagcatgtgtttggctgaagctcagctgctgtgattagctgagactaagctatctgttgtaagaatacactcaaattatgttgcagtttgtttacatactatatcaggccaaatttaatttaatctccccttttggccagctgtcagttttgagaaattgaccaaaaaccttaggcactaatactactttctgtcactatcataatggacttgttttgtctgaatatggaattcacaatttgcaatgtcaagtcagttggatgatttttttatattctctttgtgtttttattattttaactatagtgagaccatctgatatataacagatggctgcatatgaacatataagacttgagaggggccgggcacagtggcatacacctgtaatcccagcactttgggaggccaaggcaggtggatcatgaggtcaggagatcgagaccatcctggctaacatggtgaaaccctgtctctactaaaaatacaaaaaattagccgggtgtggtggtgggcgcctgtattcccagctactcgggagggtgaggcaggacaatggcatgaacccgagaggtggagcttgcagtgagccgagatcgcaccactgcactccagcctgggcgacagagcaagactctgtctcaaaaaaaaaaaaaataataataataataaagactcttgagaagatatggcatactaaggagactattataataatgactatcatgagggtaatattaagagactgaactatacttcttaataggtgcttccatgaatcaaattggtcaaaatcaaatatatcaacaacaagccagaagaggaatctacttgttttaatcaattatcttgtttgttgatttcttaaaactgaatttctatcatgtcggacataattttccaagggcaataggaggtgtcatctgttgcacacactcttccctcttcagtcaacagataggccaaagcaaccatgttatctaaaacaactttagcaagagaatttaaagatgtttgatgggcaactgtagccaatttctgctatagtagctaatgtttgcgacagatttctaatcatagtctcatttacatttatgccaagccagggaaggagcattctaccaaaagatgcctgtttagggatacttagacttgcttgcaaactcctctttattctatagttaaattaagaggtgtagaccaatgttcaatttccaattggttattggaaataatcatgacaattctaacagtattactgttaaaatccctattcaacattttccacttattgagacatggagttgctcacatatatggttggttgttaaatcctatacagataaaaatataccctggtgaggcacgacagacagttccttgccttgtgtgttaggggccacagtagagaagcactagtaatatttctccaaggctccattatgaaatcattgcatggttgaaggatcttgacaattaaagggattagggtgataaatttctctacaaactgttgaattacctttcttttggttatcctattccatttctggcataatgtaactgcaaatccctcataggttttgactactgtcagatttaaacgaagaacctgatgtgtgaagctaaaagcctaaccctgtacaaaggaccagatattgctcttagaacatcagagaaatttgttagaaggtgaagcagagaatctctaagatcatttaaggatttgtgtttaacataacatatccaacattcagttacgttgcctgcaaaagctattgattatgaaatcataataagcatgttatcttcctgggtatatataaaaaataaaaacagagaaaagaggaaaaggaccatggtttcatggtgactaaggaaagaagtcttgatctgtcttcttgggaaagctttcatgtctaggatgtcatttgtttctgaggagaaaggtccctggtcaattttgccttgaggtttccagtgggtgtactgtcctgagactgggaagggtcctcttaaattgagaaatgtggatccaaggctcaggctcaaggccctgaagttttgctgcagagaagaacttcgtgtagtcccttacagctgacttcaagggcagtctttctctggtgtctcttttgaaaagacccagtctccggggtgtagaccatgaaaagtctggttgtcatcagttcgtgggggcttcttctatctggtgaaaatataccttggcaaaatgcattaaagccttgcaatatcaagtcatgtcagagtttataaaagcagtaaatacatgaggttctattattacgggcgtaggccttccagtaaccattttataaggggtcaatctatgttttccagtgggagtggatatgattgccattttaatttgtaatacctttgaacaaggcagtgtagttagctttgcctaatgccattgtgtttataataccttatttgaatattttgcagtttgtccattgaaacatatgcctctattgctgtgattggctgggactcaactatctgttacaagaatatgcttgtaagttaggttgcagtttgtttaatcctaaattaggttgtagttcaccacttgtagaggcagcttcaggccaaatttaatttaatttaataaactaatgaaataaataagggagagtctgattcagttgaattgtatttggagttagaaatgtttattttaaagttcaccagaggatttaaatatacactgaagtttaagaatcattgctgtacaaaggtgaaaaataacatgctcttttaattttgtagtctgtcaagaactacaccaaatgtcatgtgagaaatgagcagatttgtaacaaacttaccagctgtaaaagctgttcactaaacttgaattgccagtgggatcagagacagcaagaatgccaggctttaccaggtaaagatttcaaaatttagtaaatgagtttatggtctacagataaatactgacatagaaaagtacatttagtaaggacactacattttctaaaattaaagtcatagtaaatatcaacctataatattgtagtactaataacactgtttctacaagaaaagttttttgattacatatttgcttccaattattttaaggtgttcatatgtttatgatactgttgaactgattagataccttttcatcgaaaaaaatcttaaaaatgtagaaaataataagcactcagacttaatattcagatttaacaaatactaacattttgttatattttatttaagtgccttttattttccaaactcagtgcatattttcattatacattataacatttataaaaaatattttaaggcaacaataatatagaacatattaattatatattatatattttgcctctctgtatcctaaaatatatatattatatattttccctctccatatcccagggttttaaaaatattatatatataatatattaacaataaatacataaatatattacttatataatatgtaacatatatttattaaaattatatatctagtaattttaactaaatatataatttatatatttaataaatttaaaccataaatttatatatttattatattacatttataatatataatataatataaattatattttaatatattatcctatataatataattttataataaatacatttctttttttatttttttaaaattattattattatactttaagttttagggtacatgtgcacaatgtgcaggttagttacatatgtatacatgtgccatgctggtgtgctgcacccattaactcatcatttagcatcaggtatatctcccaatgctatccctcccccctctccccaccccacaacagtccccagagtgtgatgttccccttcctgtgtccatgtgttcacatttcttataataaatatgtgcttttatgagaatccgaattttataaactacagcaaagctcatttttaaaagtaatttcattttttcacagttaacattgctagtggatgctaagtactcttcctttgaaatataaaagataaaattagaaaattgaaaggtaatacaggcatttaaccagttctgcttgttatacagataaactgagatccatgctggttaagtgatatgctcaaaattatgtgacttgtaaatgacagagttgtagctattaactaggtgttttatttctgtttagtattttacctctctttatcccaggttttttttttttaaaggtggaattatttttttattattattatactttaagttctggggtacttgtgcagaatgtgcaggtttgttacataggtatacacatgccatggtggtttgctgcacccatcaacccatcacctacattaggtatttctcctcctaatgctatccctcccctagccccctacccccactttttttttaaagaaaagtttctgagcctatttaattctaaaacatattggaaaattccatcacagaatttgtctgaaagagaatctttcttacaagttaatgtgataaaaatcaaaattattctgcctttaaaaatgccattgcggtcaggtacggtgtctcacacctgtaattctagcactttgggaggctgaggtgggtggatcacttgaggtcaggagttgaagaccagcctggccatcatggtgaaaccccgtctctactaaaaatacaaaatttagctgggtgtggtggtgggcacctgtaatttcagctactcgggaggctgaggcaggagaatcacttgaactcaggaggtggaggttgcagtgagcagagatcacgccattgcaccccagcctgggtgacagagtgagactctgtctcaaaaacaaacgaacaaacaaacacaccattgaggcgctggaatgtcattcatactttgaattttgtttacatactggcccttaaagcctttaaacagtgcgatgtgcatgtgtgctcattttgagaaagatagtattaataatgcagtaggcagggtttaagaagcaacagtgagatgatactaagaagttgaaagtggtattggtctctcagaattaaactataaaatgaaaatgtagatcaatgaaaatatttacaaagtttcctgaaaatgacaaggttaatcttggaccaaaataagatttgaatgaaggaatgtatacatttcaaggaatattactttgataagaatggaaattagttgccagtggaagtttggaaaaatgatagtaaagttacttttggtagtactcatctactcattccctaggaaaaaaatgttgctttgttataaaggctccacttgaccaggctattattttggaaatgtaatgaaatatattatgcacaaattctcttttcttaattcatatttactaagcagccaactggttatatatcgtttgatttccattcagcttatctcaaggaagtgaatgctctaaatagagggcccagtctgtagagcagttgtacaattccatgacaattggtgtattgcattttttttacattgatctcatatgagcttggcaatttgaatttatctcactaaactcattataaattaattgccttccttttaaccccactgctaagttgttgcttaatactacaaaagcctgaagtataaaaatatttggtttggtagtataatttagtttagccacaaaggcccatgcatttgtttttatttgtatgatttgtcaatgaactatttttgttctcactaaaaaataaatgaggagacaggcaataataatctaaattcttccttgattcagtaaggtgagaaaaaaccgtaatttaagaaaacgtttgcattgtaaggaaaagttttttggtattttggatttaaaaggactgtgaaaattgaaacacatatagcttcaaactgaaaaccagggcatgctacacagtcttattaaatgataattatagtttattgagggattactatgttccaactgctgtgagattttcatggtacccaatttaatccttagagcagcaaccgtgaacgaacaggagtccccaagatgctttcgagtgggtccatttggtgaagactaatagtactgagacattatttgcttttaaaattttccatttgttatgggtttaccatggagttttataacggctatctgttgtatgctattccaatagactgaatgtagaagaaggtatgagaatatagctgtcaaatgccaaatattgaagacatttacaaaaatataaaacaataaaaataaaatatgctattaagttgtaatgttccccttcaacattttgttatgaaatattaaaacagaaatattaaaaaacagaaataattgtggagaggacacccaatacctacattctagattctgcaattaacatattgctctatctgcactatccctgatctctctgcctatccatcccctattcattcattaatccttctttattttttgatgctgaggtctaatttgaattgtcagctactttccctcgggaagggaatttgaggatacgtttcctttgggcctatttgtataccatagtggggcaagacatctcagcagctggaagagtgcatttatagtggggtttaaaattattattttaaatgaataaatacatgtatttgttaaagttaccatttttaattttaaaaccatttttaattttaaaacgctccaaatcagtagatatagcatgcataaagagaagttctgtgggaccctcaataatttttaagacttaaagaccaaaaatttgagaacagctgctttagaacaactttataagagttgcagcaatatatccaaggtccttcatacagggctagaggcgctaatacatttcatatgatatagaaactaaaatgtaatctaactttatagatcagtatatcaatgaaacactattattaattagtgcacactaaagtttagccttattaatatattatataaacctgtgttttggaaaacggtgtttcaagttcaatttggattctatagataaaccattattactgaacagtatgtttcatttttagaaagacatgaataattgtgtaaaaataaacattagcaaggaaagatcatagctactttactaatcataagtgaaatgagacttctctacccatgcttatgaaagaatcagagaacccaacttataccacaactatatacctgagctatagaaattagatttagaggtcaattagcttcacttataggagtaactttgaaactgcttctgttataagcttgttgtttttctattaaagtaatcttgtcttatgtaaactagaccttgggacataaatatagtagtgattttacttattgaaataccatatgccaatataccagatgttacacagaaaacctagcagtcaacacatttaacagatgtcatagagccataatttatctcatgtttaagatttaaagaaaaagttgggatgttctgctttcattctctaccaaactattagaaaaatttatttgaaatattgagatatttaatatgttttatttcaaaaataatttaaacaaatacagaagtactttgaaataattgaaaaatacatttgctttttggtaatctaacaataagacacattttttttcttactagctcatctttgtggagaaggatggagtcatattggggatgcttgtcttagagtcaattccagtagagaaaactatgacaatgcaaaactttattgctataatcttagtggaaatcttgcttcattaacaacctcaaaagaagtagaatttgttctggatgaaatacagaagtatacacaacaggtaacatttctacttgtttacattatggaaatatgctatgataatttcataattatttgaaatttttttttggttttaatacattattgttgctaattttggaaataaaagtgaaattgatttctcaagtgaattggcagaagacttattttgtataagtaataaggtaataaggttttgtaaattatcactttttgcagagtaaaccactgtattaccttaccaagaagtgatcttatatgaatagatacacttaaagagtatataatttaagaattataactgcacttggtatagtgtggcagaaacaatttttgctgaaaacttttcagagcaattatagtcgatcctctgtatctatggattctgcattcatggagtcaaccaaccgcagatgaaaaatatttttaaaaagtatggttgtgtctgtactgaacatgtacatactttttttcttcccattagtctctaaacaatacggcataacagctattcaataacatttacattgtattcagtaataatctagagatgattttaagtatatgggaggatatggataggttacttggaatactatgccattttatattacataaggggtatgatatttatggatgttagaatccacaagggacctccgtatcctccatggatacagagagatgactatgttaccaattacttgctatatagaaacaagtaatgcttacttgttacagcttactttaaagaagcattgtagatagcatatcaaaatggtggacagcataaaatctggacatatgcttatttctacaacttagtagcaagttaacatccctagctctatgtttctcatgtgtaaactggcataataatcatggctacttcatatgtttattgtgggtaataaatgagatactgcatgtaaagaatatagaaaaatttatttttgagagttaactttggttacaatttttactatttccattttaagggatactatttttttgtctttgttcccactactgctattactactatttccaggaatcattatttagacaatgaatttttaggtaactaaatgaatatttctggtaaatagttaatattgaaactgattgtggaaaaatgtcttaatttttctatggtaagtacatttttttgttcaagcttctattaaaatttattttattgtcactgaagaattgtatgtatttatggggtacatagtgctggtttaatacatataatgtatagtgagcaaatcagggaaattagcatatccattatgtcaaacatttattatcatttacttgtgttgggaacattcaatatcctccttctagccatttgaaactatgtgatatattattgttaacaatagtcatcctacattattatagaacattagaacttattcatcttatcgagctgtaattttcaatcctttaataaatctcttcttatccctccctttcgccttactcttcccagcctctagtacctctcctctacattttacttctataagatcaactgtttttttttttttttttttttttagcttccacttatgaatgagaacacagggtgtgtaactttctgggcctctcttattttacttaacaaaatgtcctccacttccatccatgttgccatgaatgacaggatttcattcttttttaatgactgaatattatccccttacttatatttaccacattttgtttatctatttttttcttgttggaaacccaggttggttccacatcttggctattgtgaatagtgctgcaataaacatgagaatgcaggtatcccattgatatactgattttctttcctttggataaatgtccagtagtgggattgctggaacaaatgatagttctatttgtagttttctgaggaacttctatattgttctccataggggctgtactaatttacattcccaccaacaacgtataagaattcccttttctctgcatcctcaccagtattttttgactttttgataatagacatctggaggtgagatgatagctcgttgtggtttttatttttgtttccctgatgattagtgatgttgaccatttttttcacacttttgttggtcacttgtatgtcttcttttttttttttttattttttttgagacagtctcgctcagttggccaggctggagtgcggtggcatgatctcggctcactgcaacctccgtatcctgggctcaagcaattcttccgcctcagcctcccgagtagctgggattacaggcgtgtgccaccacgcccagctaatttttgtatttttagtagagacagggtttcaccatgttggccaggctggtctcgaactcctgacctcaggtaatccgcccaccatggcctcccaaagtgctgggattacaggcatgagccaccgtgtccggcctgtatgtcttcttttgggagatgtctgttcagatcatttgttcttttctaattcagattgtggttcttttgctgttgaaattttttagttccttatatattctggatattaattccctatcaaatgaatagtttaccaatattttctcctattagtctgttttcatgctgctgataaagacatatccgagactggggagaaaaagaggtttaatggacttacagttccacatggctggggaggcctcagaatcatggcaaaaggcaagaaggagaaagtcacatgttacatggatggcagcggggaaagagagggagagcttgtgtaggggaattcctctttttaaaaccatcagatcttgtgagacttattcactatcatgagaacagcacaggaaagacctgcccccatgattcgattacttcccatcagatccctcccacaacacgtggtaattcaagatgagatatggatgggaacacagccaaaccatataatctccctttctgtaggttgtcttttcactgtgttgtttcctttgctgtgcagaagctttttatttttatttaataccatttgtttatttttgctttagtttcctgtgcttttgaggtcttgttcataaaatcttttagtaaacccattcctgaagttttttcatatgttttcttctagcagttttattgttttgggccttaaatttagttctttgatccatttttttgttgttgtttttgtatagggtaagaggtgggggtctagtttaattctaatgcatatagagatccagtgtttctagtactatttattgaagagattgtcctttcccctatgcatgttcttggtgtaattgtcaaaaatcagctggctgcagctatgtgaattatttgtgggttctctattctcttcaactggtgtatgtttatgtttttataccagtaccatgctgttttgtttactacaactttgtagtgtattttgaagcctggtagtttgatagctctagctttgttcattttgctcaggattgctttggctattagggctcttttttgttccatacaggttttaggattgcttttcctatttctgtgaacaatgtcattggtattttataggtagtgcattgagtctgtagattgctttgagtagcatggttgttttaacaatattaagtcttctgatccatttgcatggaatgtcattccatttgtttggatactcttcaatttctttaatcagtgttttgtagttttttttttttgtagaggtcttttaccttcttggttaaattaattctaagtattgtaaatggtgttaccttcttgatttattttccacctagtttgttgtttgtgtatagaagtgctaccgacttttgtgtgttgattttgtaacctgaaactttgctgaattagtttatcagtactaagagttttctggtagagttgaagtggtgtcattcctctagggtaatacccgaggttctttgcctcacaccaaggaaatcaaggacacagacacacaaggagtgaaattaagagcagaggttgccaggcatggtggctcatgcctgtaattccagcactttgggaggctgaggcgaatggatcacctgagatcaggagcttgagaccagcctggccaacaaggtgaaacgccgtctctactaaaaatataaaaaattagctgggcctggtggcgggcgcctgtaatcccagccacttccgaggctgaggcgggagaattgcttgaatctgggaggcggaggttgcagtgagctgaggtcgtgccattgcaccccagcctgggtgacaagagtgaaactgcagccccccacccccgtccaaaaaagagcagaggtttaataggtgaaagaaagagaaaacctttctctcctgcagagagagaggggctctggagtgggtcttctagttctgtggtgaaatgcatggggttttatagacaagcttaaggaggtggtgtctgatttacatagagcccaaaagattgatctgaccaggtgtgtcatttacatagtgaagaagctggctgccctaccttaatcttttattatgtagatgggttctctacttggctagtgccatgttgcctgttcctttactgtacacgtggttgacaaagaaaagggaagatgtagcctccacgttgaacatgcctggcccccaggtagccttcacctagtggcacagctgccggcattcaccggtgtaagcttccagctttcttatctctgtctgcagctcaatttcacaggctgctctttgttagaaaaataatgattttggagctgctttttgttaaaagggaagtcttgctcaggactctcttaccctcactatctacctaaataatttctttctagttcttgtataagagtcttaaggtttttctctgtatcatgtcatctacaaacagggacactttgacttcttctgtttcaatttggatgtcttttatttcttctgttgcctaattgccctggccatggacttacagtgctgtgttaaataattgtggtgagaatgggtatccttgtcttgttccaattcttagaagaaaggcttttagcttttcctgttcagtatgatgttagctgtgggtttgtcacatatggcctttattattttcaggtacattccttcctaaataaaggtatttatttatttatttccttcctaaattaggtaattcctatgtaaatacctaatttaagtttttatcttgatgagatgttgaattctgttgaatgcttttgctgcatctattgagatgattgtatggtttttgtccttctatcgatgtgatatttgatgtttattaatttatgtaggttgaaccatccttgtagcccttggataaatccttcttggtcatggtgtgtattgttctgatattgttggattcattttgctagtattttgttgagcattgttgcatatgttcatcatagatattggcctctaggttttttttttttttttttttaatgtccttgtctggttttggtatcagtgttatgctgacctcatagaatgagttaagaaaatcccctctccttcagttctttgaaataatttgagaagaattggttttaattatttttgaaaggtttggtagaattcagcagtgaagccatctggtcctggacttttctttgttgtgagacttttcatcattcattcaaaatcatgaattttgttggtattttcaacttttctatttctttttggttcaatttctaggtttcatgtgtacagaaatttattcatttcctgtaagttttcaatttcttggaatatagttgtttatagtagtctctaatgaccctttatgtttctgtgttattttaatgtctcctgaattttcacttctgattttatttatctgggtcctctctctttcttgtttggtctagcaaatggtttatcagttttctttattttttgaacaagaccaacattttgtgtcattgatcttctgtattattttagtcctgatttcatttcaataaagatcatgattgccatgatctttatttttttccttcttctaattttggattttttttttcttactttgctaattctttgtgatgcaacattagggtgtttatttgaaatcattctgtttgttttttttgatgtagatgtttattactataaacttccctttcagtactccttttgctatatcctataggctttggtatgttgtgtttctgttttcagcagtctcaagtaatttttaaatttcattcttaatttctttcttcacccagtgttgaggactatattgtttaatttccatttattcacattgttttgaatgttcctctttttactaatgtctagttttattccattgtggtcatgtaagatagttggtatgattttgatttttaaaaatttgttgatatttgctttgtgtcctaccatatatggtcattcctggagaatgttccacatgctgatgaaaagtatgtgtattcttcagtacagtgttctgtaaatgtctgttagatccatttggtttatgctgcagtttaaatctgatgtttctttgctgattttctgtctagatcatctgtccaatgctgagagcatggtgttgaagtctccaagtattattgttttggggcatatttctctttttatatctaataatattttccttatgtatctaagtgctccaacattgggtgcatgtatatttacaatttatagtctcttactgaattaatccctttcttattgtataatatgcttctttatctcttttacagcttttgagttaaagtctgctttgtctgatataagtgtagctactcctgttcacttttgctttctgtttgcatggaatatcttttttcatcccttcacttttagtctatatatgtctttccaggtgaggtaagtttctcttaggcagcatattgttagttatttttttaaaaaataccctcagacagtctatatctcttaagtaagggaattcatttactttcaaggttattattggaaggtgagaattattcctatcaatttattggttgttttctggttttcatacatcttttcttcctttgtatatcctttctatcctttgttcctttcttcctctcttattatttatttttgtagttacatggctttttgtagtgatatggttttatttctttctctttctccttagtgtgttggctctaccagtgagttttataattttgtatatgttcattatgttggttatcatcttttctgttctagatgttaggctcctttgagcatttattgtaaggctagtctattggtgattaatttcattagattttgtctgtggaagatattatttctccttaatttctgaaggatagcttttctgggtataatatttgtggttgacagttttttgttttcttctcaatagtttgaatatatcattccattcctcttggcctttatggtttctgctaagaaattcactattgctgaaatggggattttcctatatctgactttatgcttttctgttgctgcttttagaattctttctgtttgattgttgatgatttgagtattgtgtgcattgtagaggacctgtataggctggatctatttggtgttctctaagcttcttcgacctgcatgtccatttctttctgaagacttgggaagttttcaagtgatttattaaatatttctagacacctgttcccttctgttctcttttgtagttcctataatacaaataggttttcactaaatgtttcttgtaaatgctgtaggccttcctcactccatattctattttatttttgttacctgtgttatttgcttttaagtccagtgattcttctagctgggcatggtggtgtgaacctgtagtcctagctacttgggacactgaagtaggaggatcacttgtaagcccaggagatcgaggctagcctaggcaacatagcaagatcccatctctgttaaaaaagaagaaagagtaattattttttctgcttagtcaagtctgtggttgaagctctctgttgcatttttaaagttttattcattgaattcttcagatctaggatttattttgttctttttttctgatatctctgttgttgaatttttcttccaaattatgaattgtttttcttattttgttgaattgtctatctgtattctcctatatctcactgaagttccttaagattattttgaattttctttctgatatttcatatgtttacttatgttgggttctattagtggagaaatattgttttcctttggggatatcatgttttctttgctttttcatgtttgatgtattcctacataaaattcttccaattttatggagtaggttttgtatggaaagaattattagtatgaatgggtcttggggtattagttcaatggggtgtattggtattggttctaggtagatgaagtagtgtagtctccatgtagtttcttcagctataatccacattagtgacatagtagtgacattttcaagtgtcttggtagcctttgcaaagagagtttgtagcagtggtgatgtggctttgttggagagtgtgctcaccttgctgtttctcagattacgggcatgtgagtacacacagtgggtagggcaacttgcattctggcttgctggggttgaggtcataggactgtcactcttggagcataggcatgcagtcacttggctgacctgggggcttgcctgtcaggaacaacctatgagattggttttcaagcttaagatgtgagtgtatagctgctcagttggcctggaaagattttttccagggttggcctttggggctgtttttcaggcccaggagacaagttgaaggctgcttggctgtcctgggggcttgcttgccaggaacaacccacagggctatttcttaatcccaggatgcaggtgcattgctgctcggctggcttgggggaatatctgctgggagtgcctcatggggtcgtgtctcaggcccaggatatgcttatatggctttctggcgagcctgtgggtgtgcctgccaggggtggcctgtagaggtgtttctcaggtgctggatgtggactcatggctgcttgtattgcctggaggcatgcccaacagtggcagcctgtggaactgtttctaggccctgattgccagtgcaaggcttttaggcaggccaagggcctgcctggagaggttgcaatgtggctgtttctcaggccctgagtgcaggcatgtagccgctcctctggcctaggggcgtattagctgcacagagtctcaagggcctctcctgcttgggggagggcatgcaatggtttgactggcttggctggctcaaggaccacattgtcctgtgtgggactgccagaacattcctttggctcagaagtgcagtggtggggattggtttccctgctgtgtaggaccagagtcacagccaatcctggacctaggctccattcagctggggttgtggcattcagccgcctgtgtgggcttggtggaacgaaaatgaactgcagtactggagagatgcagaggctactggacacttgagcaaggtacactccagaggtggctctggtctcaacatggcaccatgctgcagcatcttggctcaagggcttgagtagggaatgagaagtgcacaccttgtattcttaattgagggcaatgcagctgagggaattcctggcagcttctaaactgggctcagagcttgtaaggactgtgggattcttctgtagtaaggattataggtgtttttggtagcaatgggggctggtggggatcttctccttacctattccctataacacgaagtcactgctgatcctaaacagatccaatccaggtggagaagacagggcaaaggctgggtgcctccatgctgcctttctggacttccattcaccacaggtgcatctccactcccccactgcactccagcactctcccttcgacactccagtcaaagcatagctctttattcattgtctcaatcctctcttgtggtagggatgagcaccaggtgtctctagtcagacatcttgctgacatcactgctgaaatttttgtatggacactcagtccactgttactgccaaccctaatttttgtgatgaaatatattaatattagcatgtatatttctcatgagtatcaataatggataatctaatttctatccccagtttctgtctatacagccaaagccctcttccccattaataaaactgatgaattaattatatcctttggcttttataaatattaaaatattttgaagtggatattgcaatatggtacttcttggccttaagttttttttttacgtctgggattaatagggtaaagaaaaactatactaatcatatttatatgaacagttgattcaggaaactacttttctgtgaactgtagctatttttctgtgaaggatagagcagtagttattcatttggtatacatttattactttcagtgtacttggcaatctactgctttctgagattacagagatcaaaagacaattgctgttctcaaagagcttagtggggagagaaacaaacacaattctactgaaatgtgataattgcaatgatagatgcacacagggtgctatatgaagataaagggtaggcatctaacgagtaatgtggacctaagaataatttcctagaggagtgccctagctatgtcttacaggatttggagttggccagcacatgaaaatattggtaaagaggccagagaaatgcctaagtcttttctcttgtcttgagagctactagcttaatggctagaggataagatatatgaggtagcatgtaggagagacctatcagttttataatatttttgaagaatgtgacaaggtgtatttgtaaagtattatttttagcatatgggacaaacaacataagttaaaatctgtttatattcttgtgatgccaggagctttatttcttttactacaaaaaataagggacaattaccgtccgggcgtggtggctgacgcctgtaatcccagcactttgggaggctgaggcaggccgatcacaaggtcaggagttcgagaccatcccggctaacacaatgaaaccccgtgtctactaaaaaaaatacaaaaaaattagctgggcgtggtggtgggtgcctgtagtcccagctactcaggaggccgaggcaggagaatggcgtgaacccaggaggtggaacttgcagtgagccaagatcgagattgcgccactgcactccagtctgggcgacagagtaagactccgtcttaaaaaaaaaaaaaaaaaaaagggacaattaccaatgaacatgtgaaaattagttctcactaccacttatgcagagcttattattggcagattcaaattccctgatatttagaaagtactgatatttgatattagaactctgttgttttctttcttgcttaagacatattatttttagttcttacaatataaccttgaaatgtgcttttttgagattgcatatttcaagattgttatgttagtgttcactttttcttccctattataaataataatgattgaactaataattattttgaatgtgtgatgaacttagacttgataagttcatcacacattcaaaagttccatttgctaaggaatgtgatgctaactagcatgccctgtaaatgaagaatgttttggtttatcagaaagctgaacttcagcaagatttcaaaggtggagacttctgcaaggtgacattcaattatgcatatctttatataaaatgaattctgagtcattacagttgtataaactgaagataacccttttttggcaaataaagattgacaaattcatgcactttatagagatatcttgggtcaaatgatcatttacttatcagaaatggctaatgaaatgttacagtgatttatggtgtgctgcagtaaattttcataatatagttatttatcttacataagataatgaactgcctgtccagttcatttactgagtaatagttactttaaatgttttatcagcagctccatttttctgttttcctcctcttcctctcagatttttatcacgatgagttagggagtaatatttcattttaaatgacttgtcttgactatagatagttcagggatataggcagaattgctgtcatgtgaaacacagttgttaatctgaaatatctatgttgaattgactcctgctgttattatcaagagctataagaatgttttaggtttttgcttattaaaatatttttcagaataatatatgaaatatatgctggtcacaatgtgaagcagcatgtgtgtttttataattagaagcattatttattaagtaccatctttgttttaggcactgtgctgatgatggaagataacaatttttattctaatgaattttgtttagcaaaatttactgattacctactatatgtacagtacttgggcaatatcagatctattgtcataacaagaatttataagatatttaaattttatccaagaaacatttgttgagtgtttactatgtgaaatttattgtatttgtactctgcacacatttctaggtgtggctatcttttaagatctctaggactatatgcacatcataattagaataaatactggatataaatatcttatttctatgttgttaatgtctaaggtggagaaacatttttctctatcctggtactccataatgtttaaaaaaaaagaacaatgtggagttttgacatcatttcacattgtaatataatattggtagcttagtattttggaaaataaatctattatcatatatattaaaatagagatgtttataatataaaaaattgtaaagattagtaacttggatcatgaatatatcatttttaatataagaacattttaaaattgagtaattattaaggttataaatatggtaaagatttttatttcaagttaattttgaaatattacagcattaagaatagttatgtagtatttgtcaatcttagttaaattataggcacgagcatcagattttattacttttgttgttttttgttaataaaattatatgacataaatttatccaaaaatcatatagaagtccagatttatttgtagacgtctgagctaagagagaggcagttattcttctgtaagtctttttgctaggtcttgttatgaagtcttcactcagactctatatattgtttgttgattttattttctagtttcacaatgcagataatggcaatttatctttagagtcttaatcctataactgattacattgatagtagtaatagtaatagaagcagcagcagcaataacaatatgttaagtttttaaataatcctaccttatcagatagataattatatctccactttatagaagagtaaactgaggttcatgaaggctaaataaattattccaatcatgtagctaaatataaaacctgtgttttaaaaacagtgttctattctacatcattctccaaaatatgctataattgttaattattcttagtactaaaactcattagaaaggcagctttatatattttcaaatataatttttaatgatagtgaactatttgctaaggaatatgccatatttttacatctaactttctttgaatgccccttttcctgttgtttacagaaagtatcaccttgggtaggcttgcgcaagatcaatatatcctattggggatgggaagacatgtctccttttacaaacacaacactacagtggcttcctggcgaacccaatgattctgggttttgtgcatatctggaaagggctgcagtggcaggcttaaaagctaatccttgtacatctatggcaaatggccttgtctgtgaaaaacctgttggtaagtagtccagtaaattagcattcctttaaaagtatgtttcccacccatcttctcattccttccttctagggtgtagtcttattctatgatatttatgtaaattttatttttatacacattcttccccacttactattagtgatctcagcattaacttgtgaaaataacataatattattattttatgcaaactttgttggttcaaatagtgagattgtggttgtagttacttataatatgacaataatctattcttaattcattaatgtcttttacttttatcatgatagtgtttgggaagaagatttgcttttaagattaatggctaattgggactccttttactcttgtagacatatttcagttatcaagtaaaaagaaacatttttgttacatcttctgaaatggatttttgttaagtaagaaaggaatattgaattcttttcttttaaatcttatatttttatcatggtaaaatgtacttaaaatttaccattttaaccattgtaaatgtattttaatgccaattcaatggcattaaatactttgacactgttgtgcaaacatcatcaccatttagctccagaactttttcattttgcaaaactaaaaatctgtacccattaaacaataactctccatttcctccaccccaccccctacagtccctagcaactactgttctactttctgtctctatgaatttactacttcaggtacctcatatggtgaaatcatacagtatatgtgctttgtgactggcttattcccttagcataatgtctttagggtttaaccaagttgtaggatatatgagaatttccttcctttttaaggttgaccaatattacattatatgtaaatactacattttgttcatccattcatttatcaatggatacttgcgttgcttctacctttttgctattgtgagtaatgctgctatgaatgtgggtgtatgaataactgttcagcttcttgctttcacttctttggggtatatatatatagccagaagcagaattacaaaataatgtggcaattctgtttttcacattcccaccagcagtgcacaaaggtttcaatttctctccatccttgccaatatttatttcctattatttttaaataatggccatcttaaaggctgtgataaatattgtatcttgtgtaatattttatgataagctgtatttttattctttgtttatatcaaagacatgttcacttacaggacatttactttgtaagatgtggaatgctatggaaaacgtggctgggaaaaaattgtggctgggaaaataaacagtgctggtatacaaactaggtcatagattacattactgcttataatacttaaaattatacaactttatatactttgtaaagaattacaaatttcaaaggagttatacattttcaaatttaataaaaattttaagaagtattgatatatcatctttgtttttatctacctcatcatattataatgccacagttggcttaattgaaacatgccctgaacagcaaagcaaagaaaacccatacaattgtgttaacatgaagttaaaaatgaaattattgtatttgtttatttattccagttagtccaaatcaaaatgcgaggccgtgcaaaaagccatgctctctgaggacatcatgttccaactgtacaagcaatggcatggagtgtatgtggtgcagcagtacgaaacgatgtgttgactctaatgcctatatcatctcttttccatatggacaatgtctagagtggcaaactgccacctgctcccgtaagtatttatctagagtgacttttcacttgacagcaacgtaaatttacttttctgtgatgtaaagaagaattaaatatttgaagaagtttcaaaaaatgagaaaaaatattgttacggctacttttgaaaccaactggtactgttaacctctgatttttattatatcatcattttgcatgccactaagtatcttaccctaaatattaacatattgccacatatgtacagcctcttttccctgaactgtgtgtatgttgcagacagtataacacttcatgagagtgttcacctcaaacatcacagattgctttggtgagcctttttagtatcttttaatctagtgcaattcccatatcttttccttatatgactttgatatttttgaataacctataccaattgttttggaggtttctcaatttggatttgtctaatttttccctcatgattagattcaggaaagcattttggggcaagaatattttatcaatgttggtatatctgctacaagtatagaatgcacagtcttgaaatcacatagagttatgtcagcagggcagtactgggcttgctatgagttatacttcaggagaaagattttgccccttgctgatctctcatgttttctaaggactataggataaggctgcacctgaatgaatatttaatactgggtactatgtggtgagagtggccttgcttacaaacacaaatggcgtcagaatacagctgccaagggaattgcataatgctactgggagcacttgttagccttgtaggaacttaagaccgtgtgaaactctttctgcttgggagaaaaaagtgccaatcttagctagcttcttcatagcagagaatatggtttatctttctgcaatccactctttgacactgacgctcatcaaaaatatgccttttcacctgaattaattggtatgttcagatttggaacaaaaaagtagaaagttttacttactcctgctgctctcatgacctgtttctcaatgttggttgcattcattcatatcccactcattggtatctgtccctcttgtaattaatccagactttatgtccttttttttttgaataatatacttttcaggggcccagtagttaccattctaccaccatagaaagctgcagaatcacctgagataaagttggtatgcaggtttttttttttttttttttttgagatggagtctcactctgtggcccaggctggagtgcagtggcctaatttcagctcactgcaacctccacctccctggttcaagtgattctcttgccttagcctcccaagtagctgggactacaggcatgtgccaccatgcccagctaatttttgtactttttttagagatggggtttcactgttggccaggctgatctcgaactcctgacctcatgatccacccagctcggcctcccaaagttctgggattacaagcgtgagccaccgcgcccggccggtatccaagtttatgtccgttgaggatgctttgatttgaacaaagcaaaatatcagttatttggtaaagtccaaacagacaaataaaatcagaagttcttttgcttctttttcagttcccttcttctcaacatctgagtgtccaggaagctcacaaagaaaaaaggagcaagactccttggatttttttttcttccaatactttaacctgcagtaaacaggatttgaaatgagtgaatctaattaacatgttggtgtgtttgatccaggttccaaagaaactgtagttacagttcagtcaaaggagacaaaataacagccacttggagtctggtgtatctattaaactcaggaatatgttgtggttgaaatgtattcaatgagatagggaaagcaacagtttccctctctatacaggaattctctccaggggatctttatcccgattctaattcctttctcctaacagccctaagttctccactatcatcatctctcttcatttgtcatatttgaaacttttaaaggtcaaaggtccattttaggtttttgcatcagtccactggtttccctctgaccctttctctccaggaaacagccacttggagttttcctaggagtgtaggccataacacagcttgtttctataacgttcataagtatcttcaggactttcttattagatcattgactttcttgcagtccctccataggagcagccactggcagcctgactgatgaaaatacaaacaactatcccagcagcaatatttattttctgcccgtccactcttccttccctcctttgagctttcttgtttttcctctgagaggcaacccattctagttagcaattatagtaatgatatggctcccatgagtggaggaacaccagggctcttgtctcacgttgaattagattaaacaatacggacacacgtggagtggttttaaggagcagagagtttaataggcaagaaagaaaagaaaaggcagaaggttcgctcttacagagacagagggatgggggctccacagccgaaagaggaaaccccaagtgtggtgcgtaccaggcaggtatatgtagaggctggaggagggggtgtctgatttgcatagagcttaggggattggtttgaccaggctttcattcaggtagccctcggaaaaaaactggccttcccaccctagccttttaatatgcaaatgcagggcaccatgatgttctacacacatggggatatgtggggcggccatattcccaaatacatgtggggcaagggcaagaggacaaaggtgggaatcgccatgttgagtggacccagtttctaatggcttgcatatgcatactaaaggttgccggcttggctctaagagctgggacttttctgttagacaagaaacacttttggaggtgttttaaaaagaaatgaaaactttccaaggactccttttttctctatctgcctaaaataatttcttaataacttctatcacagtaacttcataattctgagatccctgttggtggtaaatctagtatgttgaagcctgtaagtgtatggcccttggacaacatggtcacccagttgatactagtccttcttgctcagatgagtcatcttcccatttagaggtagccactgcataaggcaatgcacgtagagacttactgactttctaggcctttcatcactctcagtggtccagtcaaatatgtatttggtccatagtgggcaccactgttacttgaagagctaaggcaaaacagtaacacaatgcaggctggaatcccagctgcagctgttgtgttcatttgttccttcaggctcttggcatgaagtggagaggtatgcctgggatggacatggttggatgtattatgagttgagctccctgttgatatccttttttagggattgtggtaaggaatgggggtgttgtacctgatcaagtgggtggcagtgtggtggttgcaggcataaaatggcctttgtgcatagcaaaacatttcaaaactaggagccagctgcccaggagagttgaatacaagagttgaagacttgtggggaatgagacaatgcgcaccttctcctgcctcaatagtcatgcttgtctctcgacaaacattattgttcaatgaaagaagctagacatgaaagattacatactgtttgactacatttaggtataaagttaaaaaatagtcaaaacggcactgtattgtttagaaatgcgtatttaggtggtaaaactatagagtaaggcaaaagtgtattctcaaaaatgtcagctagaggatgttgctgggggaagtttaggggtgctgattaggaaatgaaacaagagaggcaatgctccacttctaggctttgtgcaggtccagagtgtgtgtttataggaatttattaatcttatatttttctttatgtaattgtatgtgtgttatatttcacaataaaagaggctagaaagtagggaaaaactggtttgtgaaagtctaagctcttatactcttaacaactttctaaaaattatttagaattaagcttatgttgtcacaaatttttcttatatcccattccttctcatttgttctacttttttgtttttttacaattttttttggtggtataacacacataacataaattttaccattttaaccattggtaaataatctttagtaatttctttcaaataaattgtgacataaacttttgagtctttgcatgtctaaaagtgtacttttcattttcacttgaatgataaaatggctaaatgtggtattccaaataattttttccttggaacctctttagcactcagtgttgtggataagaattccaatgccaatctaattttcattcctttgtggaacatcttttttatcccccctttgggagcttttaagatttttttctttcttgttggcattctaaaatttttcattgttttaattcagtttttcagtgattgatgtggatctttaaaattaatttttttttacagtttttcattgaagaaaaggatttttagattttttagattttctcattggctctttaaatctgaagagtagtttgtttcttcatctgctaaaaatgttgtgtaatgtcttaaaatacatgttttcttctctttactcttgttgcaaatattaaaatagttgctggaacttctagatatatcttaatatttcttaactctgtttgcattttttgtatttttgtttgctaatatttagctatttttctttttataatcctttgagactttttatttatttgaaataagttttttgagaacaatataattatacagtgcaaatataaaaattgttgtaactgattttttttgagaaggttaatgaaacataattcactattttaacacaggtatgaattaaattctaccactgacaaatcaaataatgataactaaataccgctggtgggattgtcagctaggcaagcataagtcaggtcttcaggtctgccattgtctctcttgtttttgatcttttgcttcttttgttttcttgattattatagaggcttcattgtctacttctaccatttgttccttgagcagatagtctagtttgctattttttctcctctatagttcctttctctgttctgttgtcatgttcgcctttcctgaagctgtgtatagatcatttgtgctgataatgtccaatactactctaacagttatttctatttcacagggtttttttgttggtttttgtttttttgagacagagtctcgctctgtcacccaggctggagtgcagtggcacaatcttggcccagtgcaatctccgccttctgggttgaagcaattctcctgctgcagcctcctgagtagctgggactacaggtgcctgccccatgcctggctgatttttgtgtttttagtagagacggggtttcaccatgttggccaggctggtcttgaactcctgacttcaagtaatctgcccaccttggcctcccaacatgctgggattacaggtgtgagctactgcgcccggcctccacaggttttttattatacaccctgtgtgtcgttgtggggaagaagggcattgaacattgcctcaaggagactttgtatttctgaaagaagtagttacctggcagtgatccactgtttgtgaataatgaactccttcattatgtttaatttttcccgtgtttttaaccaacagacatttgtagagtagtgaagaaatgccaggaagtacaatagggactaggagtaaaatgacattcttgttcaaaatacaagttaaaagtagctgagtgttactctttcataggtgtcagcttcttggcaatggttttagtgtgcttttgactttaactttatgacttttcaggataaattatatatatttacattatcgttttctactacacgtctattcatttaacatttgagtctttaaaatatttttatacttatcaacaaaactttgtattggaagtggtcttttagttgccttcagaaagttgcctcaatgttcatttgaggtttactggtaaatagaaattaaggcaaacttttctttggaaatgagaaacaaataggattttgcaatattctccagtatttttcagtcataatattgtgatatcattgtttaaaattcacgaattgaagagaggaaatgttttttaagataatttttgactaatggtttctgagaaagctttgctaataattggcattattagtaattgatatattttgggtagacagatattctacttgtgaaaatgaattccagggcaatgtttaaagaaaaataggagatttagtcccaaatgtataaaggttcaaatgaaaattcaattaaatttgtatagtaaaaatagaataatacacaacttgaggataaggtgttatctcacaaatctgtatttttttcagtatttgtaagtttatgtgttcaatttaaacacttcaacaattaaggaaggtaatcatttttaaaatttgatgacaatttcttacagattgattttttaatattcttacccatttgaaaaaccattttgaatattttacaacttgatcttttgaaaagccaaaaataaataaacaggattgctccaattaaccatatttcatacaagtccttatactacacataactttaggaacaatagcatagcctgcataaggtttctcatatattatctattttgctgtgtagaagcttttgagtttaattaggttccttttatgtatttttgtttttgttgcatttgattttggggtcttagtcataaattgcttatgccaatgtccagaagagttttcctgaggtttcttccagaatttttatggtttcaggtgttagatttaaatctttaatccatcttgagttgatttttgtatatggtgagagacatagattcagtttcattcttctacatatgttgatccagctatcccagcaccatttattgaatagggtgtcctttcctcaatttatgtttctgtataatttgccaaaaaatcagttggttgtaagtatttggctttatatctgggttctctattctgttccatttttctgtgtatccccatttttctatgtatctacttttatacaaatactatgatgttttgattactatagtcttatagtataatttgaagttgggtaatatgatgcctccagatttgttatttttacttaggattggtttggctatttaggctcttttttggttctatatgaattttaggattattttttctaattctgtgagaagtgatgttggtgatttgactggaagtgcactgaacctgcagattgttttgggcagtatgattattctcatgatatcagttcttctaacccctgagtgtgggatgtgtttccatttgtttttgtcatctatgatttctttcagcagtgttttgtagttctccttgtagggatagtttacctgcttggttaagtatattcctaggtattttatttttgcagctgttgtaaaaggggttgagttcttgatttgattctcaggttggtcatttttggtgtatagcagtgctactgatcagtgtacattgtttttgtaaccttagactttactgaattgatttatcaaatctaggagtcttttggagggctctttagggttttctaggtatacaatcatatcaaagtctttagggttttctaggtatacagtataaaatcacttcatagtctttagggttttctaggtatacaatcatatcattggcaaaaaagggtagtttgacttccttgtttcctatttggatgccctttatttctttctcttgcctgattgatctgggtaggatttccagtactatattaaatagaagtgacgaaagtgggcctacctgtcttcttctagtacttagaggtaatgcgttcaacatttccccattcactgttatgtttgctgtgggtttgtcatatatggcttttattattttgtggtatgttccttctctgcctagtttgttgagggtttttaattataaagatatgctggattttaatgaatgcttttcctgtaattatttgagattatcatatcacttttgtttttaattcattttatatgatgaatcatatttattgacttgcatatgttgaaccatccctgggatgaaacctacttgatcatgatgaattatctttttgatgtgccactggattcagcttgctagtattttgttgaggattttttcatttatgttcatcagggatattagtctgtagttttcttatgttcttccctgactttgctgtcagtgtgatactggcttcatagaatgagttaggaaaaatttcctatttctcagtcttttgcaacagtttcagtaggattggtaccaattctttgaatatctagtataattcggctgtgaatcccctggcccttgactttttttggctggcaaattggtattactgattcagtcccgctgcttgttattgatctgttcaggattttgatttcttcctaatttaagctaggagagttgtgtgtttccaggaatttttccatttccactagattttctagtttgtatgcatagaagggttcagagttgtctcaaatgatcttttgtatttctgtgatgttgtttgtaatgtctccattttcatttctaattaaacttatttgaatcctcttctttgttaatctagctaatggtctatcaattttatcttttcaaaaagactagttttcatttcattggtcttttgtattttgttgctttcaattttatttagttctactctgagatttgttattttattctgctggctttggatttggtttgttcttgtttctctagttctttgagatgtgacattaggttgtcagtgtgtgatctttcagactttttgatgcaggcatttagtactataaacttttagcaccacttttgctatattcaaggtttagataacttatgtcacagttattgttctttttgcagaatttaaaactttccatcttgatttaattgttaaccccaaaatcgttcaggagcagattgttaaattttcatgtatttacatagttttgaaggttccttttggaattgatttctagtttcattctactgtggtctgagaagatacttgatatgatttagattttttttttttttttttgagacagagtctccctctgtggcccaggctggagtgccgtggcacaatcttggttcactgcaacctccacctcccggattcaagcaattctcctgcctcagcctcccaagtagctgggattacaggcacatgccagcatacctggctgctttttgtatttttagtagaaaccggtttcaccatgttggtcaggctggtctcaaactcctgacctcatgatccacccaccttgtcctcccaaagtgctgggattacaggcgtgagccactgcgcccagccgattttgattttttataacttattgagacttgttttgtggcctgtcatatggtctatcttggaaaatattccatgtgctgatgagaagaatgcatattctgcagttcttgggtagaatgttctgttaatatctgttaagtccatttgttctagagtgtaatttaagtccagtgtttctttgatgactttctgctttgatgatctgtctagtggagtgttgaagtcctccaccattattgtgctgctgtctatctctttcttaggtctagtattgattgttttatgaatttggcagctctagtgttaggtgcatatatattttagattgtaatatcttcttgttgcattgatacttttatcattatataatgaacttcttttttttttctttactgttgttcctttaaagtctgttttctctgatacaagaatacctactcctgcttgcttttggtttccattggcattgaatatctttttccacccctttaccttgagtctataagaatctttaaatgttagatgtgtctcttgaagatagcagatatttgctttgtggtttttcatccattctaccagtctatgtcttttatgtggagcatttataccatttacatgtaacattaattttgagatgtggggtacatttctagtcatcatgttgattgttactagttactttgttttcttcattgtattattactttataggccctgtgagttttatactttcaagaggttctattctggtacatattgacctttcattttaagatttagaactctttttagcttttcttgtagggctggtctggtagtgacaaaatccttagcatttgcttgtctgaaaaggactttatttctccttcatttatgaaagttagttttgctggatacaaaattattggctggcagttattctgcttaaggagggtaaagagagaaccttgatcccttctggcctgtaaggtttctgctgagaagtctgctattagtctgataagtttttctttatagattatctgatacttttgtcttagtgctcttagaattcttttattcatgttgacttcagagagaatgatgactatatacattggtaatgttgtttgtgcaatgaatctctcaggagctctttgagcttcttgtatttgggtgtctacatttctagcaaggccaggggtgtttttctcaagttattccctcaaataagtttttcagatgtttttctctttcttttacctcaggaacaccagtgattgttaggtttggctgttttacctaatctcatatttcttggagactttgttccttttttaaattattttttctttatttttgtttgattggtataattcaaaagctttgtctatgaggtctgaaattatttcttctactttgtcttagagtagtatttgtctaagacaaagtattgttaaaactatccacttgcattttgcaattttctaaatgtgcctttcatttccagaagttggtttctttttttaaaatgtattattttgttaaaatttttatttatatcctgaattgtttttttacattttcttatgttggttttcacttttctcttttatctccttgagtaacatagtagtcaaccttctgaattctttatctggcatttcaaggatttcatcttggtttggatctattgctgaagagctagtgtgatctttttggcagtattataaaaccctattttttcatattgccagaattatttttctggttccttcttatttctgtaggttcttataattatttttgaatttatttttgattcaactgtgcttttttcatttcttttttccccttgagaatgtgactttaatgtttgtagtttattttaatctaatttggctcttggtgctttcagtcatgaaggctctgtatgagttccttggtcatagagagccttttcatggtggctttctcagatactggttgtagtagtgatgtgctccatttataagtaggtgcactgtctcctgtggggttggaatggcagaggtatcatgaagcttatttcattcgccagtggcgtgtacttatttatttatttatttattctttccccagtattttattcactgggttgaacaattcagactttaggtcaataggtggtgtccacaggtaaaatctggctgttgctaaagcaggtatcatgatcctttcttaagaaaagatagttttaaaataaaacttactttcttaggaaatacctgtataacaatattagaaaatttgatttattcagggtgagtcccactaaagatttactttctcctcacgtgatatatgatacaaatcattacatgatagtaaataattggaatgccaagccaatattactaattagatattttcccttatgtcctattgatagcatagtaacccaatatacttttgaaaacaattagaataaactagttaacaatactgtgggctaactgtaatcatagatatacaataaatgttttaaaccaacaaaactaaggagggacatggtaaataggaaatgttcagttatctaaggatttttaaaactgtgtcatttagcgctgtgtactgttgaaaaaatgtaagattttaaaggaagactgtgtcaatgaattatttatctacaaatttaacattagccacttttatttaatgactcaaagagtattcttccttttttatttcttattaagaaaatacaggaggtgatacgtactctctaccttcctatgaaggcatgagatccttacctctcaaaggattgacaactacaaataatgttataattggtaaattttttaaatccagtattctattatctgtgcagagtcaacgatatcaagttcctgatattcactgagaaatttgtgccattgtttgtagttttcttaggaatgtttttgttttaaacactgagtggcagctgagccattaacattatacaatgaaattgagtctgccagaaatctaccattttttcttccattgttttttctttcatgtgactagaagacatcattcatgatgccgtgtatgtctgtcagtatcttctatttataaacaatccccaagacaaaatataatattcctagctaaataatagtaaaagtaactatgtaaataggaaaagactctcagcttaatgtaagatgctttggttgttaagtaaaggtttaaaacatttcatagcaatggctatgtctgtggtgtttgactataatgtctgcttatctttggcaaacttcaccatattcataggctttgttgagtctcataggttatacctgaatcaaaaaacaaaaagacaaaaaaccaacaacaacaaaggttgagtatctgcaaatgagtcatggagtgttattttatagccctgaaaactagaatgtgtgctctggttgcctggctgaaggagagtaccaggttttcatgttcccatccagcttggctttttggatgagattaagtttattcatcacatagtagccaaatactagtatcttggacccttgtgaggagcattgtccataataggtagtccaaatatagcccagcaatctcaggaaatgggcagacgtcacttatactggatgtccacaggcagaatacagagttctttcattgaatgtccttacgaggcacaataagaatggctaacatggatttatatcacagacaataataaaggtggtctgtagggccctaaaagttctagtactgccaaaattttcaggggtcttcaattactgattttatttttctccatgtcatggttaaccacaccttttttcactcctgtggtggcctgtttatctcctctttgtttgtgatgtatgttttatttgcttttagtaattgctgtctcttaagtattattgcaaaaatgtttgcattaactatagatgacctttcatggtttttatcatgatcatatttattttttattagcctataattctgtttgaatatatagtcatgttaacatatttgtcaatgttcctgtcacgcagctcaaaattgttctggattgagaacctgtggacagtgtttggaacagcctggatgtggctggtgcaatgatcctagtaatacaggaagaggacattgcattgaaggttcttcacggggaccaatgaagcttattggaatgcaccacagtgagatggttcttgacaccaatctttgccccaaagaaaagaactatgagtggtcctttatccagtgtccaggtaataataatgtaatggaaacaatttcagtttctgcttaagggatccaagaaggagtttttgttcttataataaagaaaatttagctttaggaaaaaagcagaatgaaaatgagactaaaatgtcaaagataaaaaattattccatagactatatctatctcagtttatgcaggtggtattcagtttagaatcattagataggctaaatgaattcatggaatatcatgattagctttcatttcttttttaatattttgttatttagtttaagttttgggatacatgtgcagaacgtgcaggttacataagtatatgtgcaacatggtggtttgctgctcctattgacccatcctctgagtttcttcccctcacccccagcccggcaacaggccctggtgcatgttgttcccctccctgtgtccacgtgttctcattgttcaactcccactttggagtgagaacatgcagtgtttcgttttctgttcctgtgttagttggctgaggatgatggcttccagcttcatccatgtccctgcaaaggacatgatctcattactttttatggctatgcagtattccatggtgtatacgaaccacattttctatatccagtctatcattaatgggcgcttgggttggttccatgactttgctattgcaagtagttctataataaagatacatgtgcatgtgtctttatagtagaatgatttatattcctttatgtacatacccagtaataggattgctgggtcaaatggtatttctggttctagatccttgaggaatcacagtgtaaaaacaagcctctttctccacagcctcgctaacatctattgtttcttgactttttaataatcgccattctgactagtgtgagatggtatctcattgtggttttgatttgcatttctctaatgatcagtgatgttgagctttttttcatatgtttgttggctgtgtaaatgtcttcttttgagaagtgtctgttcatatcctttgcccagttttttacggagttgttcatttttttcttgtaaatttgtttaagttccttgtaaattctggatattagacctatgtcagatgggtagattgcaaaaattttctcctattctgtaggttgcctgttcatgctgttgataagtttcttttgctgtgcagaaactctctagtttaattacatcttatttgtcaattttgacttttgttgcagctgcttttgggattttcattatgaagtctttgcccatgcctatgtcctaaatgttattgcctaggttttcttctagggttttttatggttttgggttttacatttaactgtttaatccatcttgagttaatttttatataaggtgtaaggaatgggtccagtttcagttttctgcatatggctagccagttttcccagtaccatttattgaataggagatcctttccccgttgcttgcttttgtcaggtttgttgaagatcagatggttgtagatgtgtggtgttatttctgaggtctctgttctgttccattggtctacatctgttttggttactgtagtcttgtagtatagttcgaagtcaggtagcatgatgtctccagctttgttctttttgcttaggatcgtcttggctatatggggtcttctttaattccatatgaaatttaaagtagttttttctaattctgtgaagaatgtcaattgtagcttgatgggaatagcactgaatctataaattactttgggcagtgtggccatttttacgatattgattcttcctctccatgagatagaatgtttttccagttgtttatgtcctgtcttatttcattgtgcagtgcttgctttgtagttctccttgaagaggtccttcacatcccttgttagctctatttctaggtattttattctctttgtaacaattgtgaatgggagttcattaatgatttggctctctccttgtgtattgttggtgtaaaggaatgctggtgatttttgcaaattgattttgtatcctgagactttgctgaagttgattatcagtttaagtagtttttgggctgaaatgatggggttttctaaacttaaaatcatgtcatctgcaaacaaagaaaacttgacttcttctcttcctgtttgaataccctttatttctttctcttacctgatagcccttgccagaacttctagtaccatgttggataggagtggtgagagagggcattcttgtcttgtactggttttcaaagcaaatgcttccagcttttgcccatttaatatgatattgctgtgggattgtcataagaagctcctattatcgagctgtgttccatcaatacctagtttagtgagagtttttaacatgaaaggattttgaattttatcaaaggccttttctgcatctattgagataattgtgtactttttggctttggttctgtttatgcgaggagttacgtttattgatttgcatatgttgaactagccttgcatcccagggatgaagttgacttctggtggataagtattttgatgtgctgctggattcggtttgccagtattttattgaggattttcacatcgatattcatcagggaaacgggccagaattttctttttttgttgtgtctcttcctggttttggtgtcaggttgatgctggctttataaaattagttagagaggagtctctccctttcagttgtttggaatagtttcagcaggaatggtattaggtcatctttgtacctctggtagaatttggctgtgaatctgtctggtcctgggctttttttggttggtaggctattaattactccctcaatttcagaactgttactggtctattcagggattcagcttctttctggtttagtcttgggagggtgtgtgtatgtgtccaggaacttatccatttcttctaggttttctagtttatttgcataggggtgtttatagtattctctgatggtagtctatatttctgtggggtcagtggtcatatcccctttatcatttttttattgtgtctatatgattcttctttattttcttctttattagtctagctagcattctctctattttcttagtttttcaaaaaaccagctcctgaattcattgatgttttggagggtttttcatgtctctatctcttttagttctgctctaatctcagttatttcttgtcttctgctagcttttggatttgtttgctgttgcttctctagttcttttagttgtgatgttagggtgtcgatttgagatctttccagctttctcatgtgggcatttagtgctataaatttttctctgaacactcctttagctgtgtcccagagattctggtattttgtctctttgttctcattgttttcaaataacttcttttctgcgttagttttgttatttacccaagagtcattcaggagcaggttgttcaatttccatgtaagtgtgtggttttgagtaaatttcttaatcccgagttctaatttgattgccctgttgtctgagagactttgtaatgatttcaattcttttccatttgctgaagagtgttttacttccaattatgtggtcaattttagaataagtgccatgtggcactgagaataatgtatattctgttgatttggggtggagagttttgtagaagtctattaggtccacctgatccagagctgagttcaagtcctgaatatccttgttaattttttgtctcgatctgtctaatattgacagtggggtgttaaagtgtcccactattattgtgtgggagtctaagtctctttgtaggtctctacaaacttgttttatgaatctggatgctcctgtattgggtgcatatgtatttagaatagttaactcttcttgttgaattgttctctttatcattatgtaatgcctttttttttgtctttttaaatctttgttggtttaaagtctgtttgtcagagactagtattgcatcccctgctttttttttttttaactttccatttgcttggtaaattttcctccatctctttattttgagcctatgtgtgtctttgcctatgagatgggtctcctgaatacagcacactgattggtcttgactctttatccagtttgcaagtctgtgtcttttaattgggggatttagcccatttacatttaaggttaatactgttatgtgtgaatttgatcctgtcatcatgatgctatctggttattttgcacactagttgatgcagtttcttcattagtgtcattgatctttatatctcggtgtgtttttgtagtggttggtactgccttttccattccatatttagtgcttcttttaggatctcttgcaaggcaggcctggtggtaacaaaatcccttagcatttgcttgtctggaaaatattttatttctccttttcttattaagcttagtttggctggatatgaaattctgggttgaaaattattttctttaagaatgctgaatattggcccctagtctcctctagcttgtagggtttctgctgagaggtccactattagtctgttgggcttccctttgtaggtgacctggtctttttgtctggctgccattgacatttttgccttcatttcgcccttagagaatctgatggttatgtgtctttggttgatcttctcatggagtgtgttagtgatgttctctgtatttcctgaatttgaatattggcctgccttgctaggttggggaagttctcctggataatattctgaagtgtattttccagcttgttttcattctccctgtctacttcaggtactccaatcaattgcaagtttggtttctttacgaggtcccatatttcttggaagctttgtttcttttcattcttttgtttctttagtcttgtctgcatgccttatttcagcaaggtggtcttcaaactcttagattttttcttccacttcgtcacttcggctattgatacttgtgtttgcttcatgaagttcttgtgctgtttttttttcagctccatcagatatttatgtttctctctaaactggttattctagttagcagctcctctaaccttttatcaaggttcttagcttcctttagctcagcgtagttttttattacccaccttctgaagcctacttctgtcaatttgtccatctcatcgtctgtccagttctgcgcccttgctggagagatgttgtgatcattcggaggagaataggcgctttggcctttgggtttttggcatttttgttgttgttgttgattctttctcatcttcttgagtttgtctagttttgagtttgagtttcagtttgtctgttttctttgaggctgtttacccttggatagggttttttgtggggccttttttttgttgttgttgctttctgtttgtttttctttcaatgatcaggtccctcttatgtaggactgctgtggtttgctgggggttcacttcagcccctattcatctgcttcgctcctgcccctggagatatcactcaaggagactggagaacagtacagttgggtgcctgcgccttcttctgggatctctgaccttgagggtcagcaagtctgtgtcttttaagtggaaagtttaatttgtttaccttaaaagttactatttgatatgtgagggcttatttatggcattttgttaattgatttatggttgttttatatatcctttgctcctttcttattgtttatcattgtggttttttagttttctgtagtggtagcatttgagtcctttctctttcttatttgtgtccttgcttcgtcagggagttttatactttcatttgtttttatgatggcaaatattgtcctttcacttcctgaagcgtctgtttcaggtcttggctagtggtaatgaatttcctgtttttgcttgtctgaacatagctatcataatactgaagagggaaaggtgaaagctttttttttttttttttttaaagaactggaacaacacagagatgcccacttgcaccactcttgtttaacatagtactgaaagtcttcagactgagcaattaggcaaaagcaagaaattaaatggatctaaattggaaagaagggagtcaaattgtacctgtttgcaggttacataatcttatatgtagaaaagcataaagattctatcaagaaactgttagtactgacaaatgaattcagtaaagttacagaatgcctaatcaacacacaaaaatcagtagcattttcatacatgaacaatgactaggagaaaaggaaatcaagaaggtaataccatttacagtagctacaaataattaaaatacttaggaataaatttaaccaaggagatgaaagacctagaaacttttaacatatacattttaacttgttaaaatatttttcagatttatattactaccagtgagatgtaataatgttattcatataggtctattctttttcttcattttggtcttatttttgctactacatctatatatgttgtggacccaacagtactttaataaaattattactttatataattttatatcttttaaataatttgagtgatgaaaggaggataagtatatagttatagcttttattatattaatctttttaccatttctggttttctttatttgttgccatggccccaaaccatcaggtatcatacctttagcccaatacaggttttcttgactcacctattttgtgcttttattggcaaacatgttacatttttatggttataggacaaataataccattatatacatatatttaaaaataattccttaaaaatatcaggtaatagaaaaaaggaaaataaatatgcatttcctatttttattattacacagtaattaccagtactgtttttctttttgcatggagttgaactaccgtctgggtcacttgctttccttgaacaacttcctttagtatttcttgtatggctggccttctagcatctcattctcctaattttttaatatttaggaatgtcattatttctccaattttctaaaggtagatttgcttgatagaggattcttagttagcattgttcttttgagtatatattattatactgcttactggcctctattatttctgatttaaaatcagttgttaatcttattgggcttttttgtaagtgagaaatgattttatctctttcttctttcaagattttgtccttgttgctttcatcattttaattataatgggtctttttgtggatctctttgtgtttgtcctatttagagttttttaggtttcttggatgtgtaagttaatatttttcatcaaatttgagttttcagaaatgatgttttcaaataatttttattttcttttctctttctccctcctctctttccagtgtttctattattcatgtgatggtaaaattaatgatgtcccatatgtttttccaagctctgcttacttttctccattcctagttctctctgtattttagattatataatctgtcagtctatctttaagcttgctgattatttttctaccagttcagatcttctgttgaattcttctagtgtatgttattgtacgtttctacttcatttgtttttttcttaaaaatttttatttctttgttgatattctctatttgatgagacattgtcatcatacccttcttcttcaggcatgatttctccctcccctcccctcccctcccctcccctcccctccccttcccttcccatttatttattgagacagagtttcactcttgttgcccaggctggagtgcagtggcgcaatctcagctcactgcaacctccgcctcctgggttcaagcaattctcctgcctcagcctcctgagtagctgggattacaggcatgtgccaccacacctgactaattttgtatttttagtagagacagagttttgctgtgttggccaggctgtccttcaactcctgacctcaggtgatctgcccaccttggcctcccaaagtgctgggattacaggcatgagccaccgtgcctggcccgttattttttatatctttaattatttttgaatatttttgtctctttttttttcctgagacagagtctctgttgcccagcctggagtgcagtggcgcgatctcggctcaccgcaagctccacctcccgggttcacgccattctcctgcctcagcctcccaagtagctggaactacaggcgcctgccacgacgcctggctaattttttgtatttttagtagcgatggggtttcaccgtgttagccaggatggtctcgatctcctgacctcgtgatctgcccgccttggcctcccaaagtgctgggattacaggtgtgagccaccgcgtctgacctatttttatcttttatgtgtattctttgtttaaatcaactctctctctttttttaatctcctggtttttatggtgtttttgaattttttattttgagatttaatttagaatttttttttctcttccatgtcagggtttggcaaaccaaggtcggtaggccaaatctggtgtgctgcagatttacgtaaacaatgttttatcaaaatacaactctacccagttatttgtgtattatgtttgtttgcttttgcactacagttgcagaaaggaatagttgtgatagagactgtcctgcaaagcataaaatgctatctagtcctttatgtaaaaaaagttttaccaattcctttcttgtagtatatttgtataacctgggttgtggatgtatctacaagggccatttacatctgcttttacaatatctatggggctttttctgttttcagagcaggtttgtattaatattttacttggtggtttattcaccaaatatatgatgtgaatttaagattgccatataagcctgacatatactttaagttcccacaagttatgtttttctttcataaacatatcccaggggacttaaaattcttttctgctttttgtagagcttgtgatgtgttttaatacctttttcatagatagtgtctccagttgataggatcattttatgaacatggttcagtttagcttgcttcctttaggatgccaagaattatatcctcttggtctgctggattttggaacccatgcctcctagttcttattcgtctattccacgtatagtaaaatttggtcgctagctcaaatttagctttactattcttattttgaatctctgcttcatttctagcatctgataattcccatttcttttaaagtggtatatgtgttgaaaaatgctttgggtaaatttttgtcttaaatttctgtgtatatttttaaaatttattaagattgtcacaaagatatttttaaatgttgcgcatctgttgcagagtaactatttttcaaaactatgtacttatttgcatatcaaatgctgagttgtcattatattttattttgatttttttctgtttgtgtgtccataaatgaggagccatctggagtggttttaaaatttagagaaaatagaatggatgacttctctttagttttattcatattccatagctactgagatattagatgatattagaacctttcaagcaacaatgtaaacctcaacactcttatgtgcaagctgacattacctgtcgatctaacactcttttggtagtggggaatagaacataaccataggcttactaatataccattttcttgttatttgatacagccattatgcctgggtccccttttctgtaatatactttctcctttgccattgctaccatattagttataaggtgtgacaattaccagacttttttcagcagatattttttctgcaggtaggtctaaagtatactggctttctgcatcatatatagaccatgtcaggcttccttgatttatactttccaccagatggatgaaggaataccagtgatatgcttcttgactgccctatgactaacctttgttttcagaatttttcttattcaggaaaggagggttgagtggcattttgctagggaacttcttttatcatcaagaggtattatagattactaccttctagttttgttcatgtaggtcaccataatgcctatcattgctggtacatttacttattattttaccattaatctgtgagggagatgttagatatgagtgctaaatttagctgtcttattcagatgttaaaacttttttttttttaatgattcttccaaatggccagaaatttcatgaagttgttacagtaacccatttcttactttaaatcttctggtaagtctttacatgtagtgggcactcaataaattttgtttttacctgagtgaattaattagtggtgtcacagagtaaattttctatgaaacagtaccttgccagggcaactaggcaggagaaggaaataaacggtgttcaattaggaaaagaggaagtcaaattgtccctgtttgcagatgacatgattgtatatcgagaaaaccctattgtctcagcccaaaatctccttaagctgataagcaacttcagcaaagtctcaggatacaaaatcaatgtacaaaaatcacaagcattcttatacaccaataacagacaaacagagagccaaatcatgagtgaactcccattcacaattgcttcaaagagaataaaatacctaggaatccaacttaaagggacatgaaggaactcttcaaggagaactacaaaccactgctctaggaaataaaagaggatacaaacaaatggaagaacattccatgctcatgggtaggaagaatcaatatcatgaaaatggccatactgcccaaggtaatttacagattcagtgccatccccatcaagctaccaattactttcttcacagaattggaaaaaactactttaaagttcatatggaaccaaaaaagagcccacatcgccaagtcaatcctaagccaaaagaacaaagctggaggcatcacactacctgacttcaaactatactacaaggctacagtaaccaaaacagcatggtactggtaccaaaacagagatatagatcaatggaacagaacagagccctcagaaataacgctgcacatctacaactatctgatctttgacaaacctgagaaaaacaagcaatggggaaaggattccctatttaataaatggttctgggaaaactggctagccatatgtagaaagctgaaactggatcccttccttacaccttatacaaaaatcaattgaagatggattaaagacttaaacattaggcctaaaatcataaaaaccctagaagaaaacctaggcattaccattcaggacataggcatgggcaaggacttcatgtctaaaacaccaaaagcaatggcaacaaaagccaaaattgacaaatgggatctaattaaactaaagagcttctgcacagcaaaagaaactaccatcagagtgaacaggcaacctacaaaatgggagaaagttttcgcaacctactcatctgacaaagggctaatatccagaatctacaatgaactcaaacaaatttacaagaaaaaaaacaaacaaccccatcaaaaagtgggcaaaggacatgaacagacacttctcaaaagaagacatttatgcagccaaaaaacacatgaaaaaatgctcaccatcactgaccatcagagaaatgcaaatcaaaaccacaatgagataccatctcacaccagtgagaatagcagtcattcaaaagtcaggaaacaacaggtgctggagaggatgtggagaaataggaacacttttacactgttggtgggactgtaaactagttcaaccattgtggaagtcagtgtggcgattcctcagggatctagaactagaaataccatttgacccagccatcccattactgggtatatacccaaaggactataaatcatgctgctataaagacacatgcacacgtatgtttattgcggcactattcacaatagcaaagacttggaaccaacccaaatgtccaacaatgatagactggattaagaaatgtggcacatatacaccatggaatactatgcagccataaaaaatgatgagttcatgtcctttgtagggatatggatgaaattggaaatcatcattctcagtaaactatcgcaagaataaaaaaccaaacaccgcatattctcactcataggtgggaattgaacaatgagaacacatggacacaggaaggggaacatcacactctggggactgttgtggggtggggggaagtggggagggatagcattgggagatatacctaatgctagatgacgagttagtgggtgcagcgcaccagcatggcacatgtatacatatgtaactaacctgcacattgtgcacatgtaccctaaaacttaaagtataataataataaaaaataatttaaaaaaaagaaacagtaccttaagcttttaaggataatgttataaaattaaagtttttaataacattattgtaaagataatattaatttattatagacaattggtaatacagaaaaatcttactttagtaagatacccatcagcttttccataaacgtatttatacatttcatcacaaaattgtcactatgttaaattgaaacaaaatatgcacatgtttcacacggttcaatgcgatgttttaatacaggtatatgttgtataatggtcgaatcatggtaattaacatatctattaccttaaacatttataatgtgtttgttgtgagaacattcagaatcctctcttctagctatttgaaatgcattattgttagctataatcaccttactactgttcttgtactctattgcatcataggtattcctcctatgtgtaatattgtatgcattaaccaacatgtccctatctccccctcctcctattctctccagtttcttgtaatcatcattatactcttaatgtctatgagatcttttttttaaagataccatatatgactgagatcatgtggtgattgtctttctgtgcctggcttatttcacttaagaaaatgtcatctaaactcatccgtgttgtcccaaatgatgggattttattttttatggacctttttcatggctgaaaaatatttcattgtgtgcatgtgtgtatgtgtatttatttgtttattcacactttctttatccattcatccatgtttggtatttaggttgatcctatattttggttattgtgtgtagtgctgcaatatattaatacattgaagtgctgatgtctcttcaacatactgattttatttcctttggatatacacccagtagtgagattgctggatcatatagtattatatttttattttttttgagaaacctccaactgtttttgatgtaccaatttacattcccataaaaaatgtatagagttcccctttctccacatacatgccagcatttgtttttttcactgtcaattttataatttacccatggctgtttaggagcatgttctttaatttctatctatttgtatagtgtttgaagttccttctcttttcttctagttttatttcattatggtcagaaaagatacttcatatgattttgatatatttaattcattaagacttttttcctaacatattagctaacctgaagaatgttgcatatgcatttgagaagaatgtgaattctgcagcttttggatggaatattttgtatatgtgaagtcatttttgtcataaattcagtttatgttcagtgtttccccatatattttctgccttgatgatctgtcgattgctgagagttgggtgttaacattcccctactactattgttttgctttctatacctccctttggatctattaatgtttgctttctatattaagttactccaatgtgcattccatataaattctcgattgttctatcctcttgtattgatccctttatcagtaagtattgacctcatttatctctttttatagtttttgacttgaagcctattttgtctaatagaagtatagttaatcctacttacttttccatttgcgtgcaatatgtttttgcatctcattactttaagtctatgcacattcttaaaggtgaattgaatcttttgttggcagtatgtagttgggtcttgtttctttattcattgactcactgtttgtcttttatttggagaatttaagccctttacattcaaggtaattattggaaggtaaggattttgtactgccatattgctacttgttttctagttgttttgtagaacatttctttctttcttctcttactgcctccctttgtgttaagtgattttctctagcaatatgatttgatttcttgctttttatttttagtgtatatattgtaggcttttgttttttgcttaccttgagcctatcaaaaacatcttattattttaaaaggctattttgaattgataagttaattttggtcggaagaaaaggaaaaacccactctattctttaacttcattactcttctacattttgcatttttgatgtcataatttacatcttatattgtttatcccttaaccaaatcattttagttgttgttatttttatttgctttgttttttaaccttcctaataaggatataattgtttcttgacccacgattaccatgttagagtattctgaatttgtttagatacttatttttacctgtcagttttatagttttgaactttttttgttacacattaggattattattttttctttttgttcgaacaactcctgaaagtattttttttgtaatgtagttctggttgcaagggttttcttcagcttttgtttatctgggaatgtctttagtctttatttctaattaataagtttgctctatacggtattcttggcaggcagttttgttgtctttgaatatgtcatcccgctctctcttggcctgtggggtttctcctggtaactctcctgtcaggcatattggaattcctttatgtgttatttgctttttttttttttttttttctcatgctgctttcagtgttctctgtctttgacttttgagaaagtggttatatatgtcttagggttatcttatttggattgaatctgttttgttacctttcacctttctgtacttgaatatttatatctttcttcaggtttggacattttctgttattttttttaaataagctttcttccccattttcattttttattcttttttgaacactaatgatacacagatttgctcttttgacactgtttcatagaacctctgtgtttttctcattgcttatctgttttcttctctgagtgtgtattttccaatagcttgtttttgaaatcagtgattcttctgctttgtcattctgctattgatgccctttattgcattttttttttttgagacggagtcttgctctgttgcctaggctggagtgcagtggtgcaatctcggctcactgcaacctccacctcctgggttcacgccattctcctgcctcagcctcccaagtagctgggactacaggcgcccgccaccaagcctggctaatttttttgtatttttagtagagatggggtttcaccatgttagccaggatcatctcaatctcctgaccttgtgatctgtctgcctcagcttcccagagtgctgggattataggcgtgagccaccgcaggtgtgaggcctgcatttttcctttcatttattattctttttagctcctggattactgtttgattttttaaattatttcaatttgtttgttgaatttctctaacaaattcctcatttgttcctctgtgttgtattgacattgctgatttttcttaaagcagctatattttaattctttgattgcctatgatttatgtgcatatgtttaggattagtaattggcaccttgttttgggcgtttcatgaggccatcttttccaagctaatcttatatcttctttacatgtgtctctgtatgtttattgacaaattaggtatttttttccagtctttgcagtctggatttgtttgtgactgctctgtttcggtgggcttgttgacatattctgagcatactgactcttgtatttcattttagtgctagaaggtgctctgagcccagctttgacatgattgtctaatgcaggatccaaactcattgtgatcatgggagatccatattgggtgcccaggccatgtaagagatcagggtcagaccctcacatatgaaggattgtagaccatccatctgacattgtggcactcataaacatcctctgtggtggggcatcctctctgccagggatggtaagccactgccaagttctctgtgctgcctgttactagccctactctttcttttttccataggtggcctcaggtggttcagccccattgtacttgtgatgctcttcatgggctgatgcagaagcaaatctcccatgaagggattcaggatggtagagaagcataatgcctatctccggcttcctcttttgagtgtagaatccctgagtcctggagacctttctgtgtatagtactctaagggcttggggatggggtattgtggtcacagaaaactgattctcttaccatccaaccatacttttactagtctgtagtctggagaggcttcacagccttacttgtgcattcaggttttttttagccctcgtgaaggcaattgtatgtgtgagtggttgttcaaattgatgtttcttcgtgggtataattgttggagaaacctattttgctgtttgctctgcttccttgaatttaacattgccatctttctaaatataatgctctgtattaattgcttctcttaatttgtcatgaacattattccttgctattaaattttctaattgtttcataatgtaatatggagtttaaaaacattataattattctcaatttcataaagaggatgatgagcattttttcataactgcatattctttctataatgtgttacaatagacttgcacctctaagaatttctgtaaagtatttggttttactcttttgtttgtctgtttcttcacatgctaattcattttgatgatcctatgctagcctcttgggaattcctctcactttcagattttctgaatataagaggcagttttacatgctatttaatatctgttttttttttacattcaatgttccatatacatatttgtttctgtcgttgattagctgtgtgactttgtgtagttgcttaacccagatttctccatcttagaatcagtcctgaacacagcaacttccacatagcattgttttgaagattaaataataaaattcatatgtacaatttggtcctctgtctggccaaggcatggtgtttacagtgtttaaaaattgatgcttatgtacacttaccaatcagaacagataccaactacaaacaattggcaccagcagaatattggctttcctcatggagtgagagagagctcagttaaatgctagttgctatcatagttgtaataagtaaaaataatcatgagggtgacaattaagatgatttttggccaagcagttaccagactaagttaattttatgtcccaaataggcacaaagagcatgagcctttcatacatgaactttattctgaaatttttatattctgctgtaatattaacatcgaaacatggaagtctcagttacacagatatataaacaatctcatactttatatttcattctgtttagttcaaacttaaatagactttcagttaaatcttgaagtttttcttacctaaagaagatacatatttatgcaaattaattcaaaagtacttttttttttttttttgagacggagtcttgctctgttgcccaggctggagtgcactggcacgatctcggctcactgcaacatctctctcccaggttcaagcgaattctcctgcctcagcctcccaagtagctaagattacaggcatgcaccaccatgcccagctaatttttttgtatttttagtagagacagggtttcaccaagttggccaggctggtctcaaactcctcacctcaagtgatctgcccacctcggcctcccaaagtgctgggattacaggtgtgagccaccacgcctggctcaaaagtactatttttattaattttactattagtttactttattctggttagaatctattgccacactattttctatattgattgactctttattatcatgtgttaatataattaagatgaattttagcattctttatcaaagttatagtatttagccttgtgtttatataacttaacagacataccattcttatgaatttttaaggattatgctaaagattattccctctttagctataacttttatgttccagttcatctttaaccatggcattgtaaagaggttaaggtaaaatttcaacacatgatttatggtacatactgtcttgcacaaaactttgagctatatgtgttattaatttttaaacaaaacttggaagatgctctttgggcacttttacaatccagctttttaagatacattctttgttttgatagctattatacttgatattatgttagatatttgtaatgctttttactgtttcctttagcttgccagtgtaatggacatagcacttgcatcaataataatgtgtgcgaacagtgtaaaaatctcaccacaggaaagcagtgtcaagattgtatgccaggttattatggagatccaaccaatggtggacagtgcacaggtaagtttcttttaagcaaattttggtgtatttttactaaggaaaagataattaagaaagcagcgcctgttgtggagaatatatactactacagaaaattttttactcagttttagtatgttttctaaagtaatacatattagaaactgtgaactataaaaattctgtaatatgcttgattcaaaaatattcctttttcttatttcaaaatgaatgcatgtttcttattgtaatttctcaaacacagataaataaaagaaaaaacacctactatctcactattcaaaaataatcattgctgatagtttttttaataagtaataatttattgttttgacttcagaaataataattaaaagttaaatgtgtttaacttacatcaggtaagatttttattgcacagggtggtagtatagagtagtatctaggagagtatgggtttggaaccaaatctgggctgaaatcccaactctgtcactgttcaaatgtatgaccttggttcattaacctctcagtgtcttatttttcccatatgtaaaatggagatgataataattcactgagttgttgtaaaggtcaaatgagattttatgtaatataggccttaggaattgaagcacataaaaaagagcattataaatgctagccataatcatcacattcttgtttactaaaccctactttcctccatcttcctctctattctgccacttctttctcctactttgtaaataatatttgttctttaaatataatttccttttaaagtagaatttaatagaaatccttcattatctctagattggaacttgtcttttaaatttttaatctaccgtctctaaatggagtttgcctacatagcacccacagaaatacgtttttggctgtgaagatgtgaggaatttgagggagtggagcctgactctggttagataatttttttttaacactagctgcatattagaaccagctggaaagcttttaaaaatatggctgtctgggccactttctaaaacaattaaatcattatcttggttgtggttgtagggtgattcttaggtaattgttctttttaaatgtttcccaagtgactaatatgcactcagagttgagacacatggggaatgatgaactgattcaacatttgagtcaacaaaattgtgcagctaatacagttgtaccttggtatccatgcggattaattccaagacctttcctgtgtaccaacatctgcagatggtgaagtcccttacatagtggtgtagtatttgcataaaactgatgcatatcctcctgtgtacttcaaatcatctttagttgtaattcctaatacaatgcctatatttcacttcattcacatggattcaaagtatacttggtgcatggcaaatataaattttacattttggaatttgggggattttttctgaatatttttgatctgctgttggttgagttcacagatgtggaacccatgggtaaggagggcctactgtagtatgttgggtgacaaataaagataggtgaatggaagttttgtgttatgcagtgctctgatccatttgaagctctaatacagatgcattggcccacatttaacattttttatatcctaggcaccgtactaatagctttattgtcattattttatattagctttacaaaactgtatggtattactttgatcctcattttacatgtggacacaaatatttaatgcacaaagaagttatctaaaatacccaagatcatattgctagttagagtaagaaaatgtctcattcctaaacctcgctcttaactgttaatgcaggagttatgttcatatggaccaggaagatccagttgttctcacctaaaagccacagcttagtgctctgtccagtggatacataagatgcagtaattatgggccaagtggaatccacaaaatttagggtctacatactagagtcatagtgttttttaattttatatttctaaaaagaccaaggttttcaagacaagctctttctaaagtgtttcagtactgaattttccatggccatacattttattggagaaagtgcatgtgtcagataggttatgtgtgttaatgtattgattgcataatttgaagaaaaaatatactatgagatgttttcattcacattacaatttgtgtgtctctgtaaactgtcgtgtatttaatataaaattgtggtatgttttattttacttttatgaaaattattttggatatattttccaacatattttcatgcccatatgtaattagttcattctgtaatttacttaatatatttctgttggcatttatataatgcttctaaccataactccaattcttgagaatgactttttagcaaagtgaaacccacataacagacacttaactatgtacagtgttgtgcaactgtctgatttttttttctttttttttttagacagagtctcgctgtgttgcccaggctggagtgcagtggtgtgatctcggctcactgcaacctctgtgtcctgggttcaagcaattctcctgcctcagcctcccaagtagctgggggggggggactacaggggcccgccaccatgcctagctaattttttttttttttgtatttttaatagagatggagtttcactatgttggccaggctggtcttaaactcctgacctcgtgatctgtctgcctcagcctcccaaagtgctgtggttacaggcgtgagccaccatgcctgggcattttttaaagtttttaattaaaaagaattcaatttttaattttgtgggtacatagtaggtgtatatatttatggggtacatgaaatatcttgatacaggcatgcaatgtgaaataatcacttcatggagaatagggtaacctgctcaagcatttatcctttgtgttacaaagaatctaattacactctttaagttatttcaagttattttaaaatgtacaattaagttgctactgactatagtcaccttattgtgctatcgaatagtaggtcttcttcattcttcctatttttttgcacctcttaactataccccctgccctccagccctctaactattgtttttgtacccattaatcatccctaccttctccccagcaccccattacccttcccagcctctggtaaccatccttttactgtctatgttcatgaattcaattgttttgctttttagattccgcaaataagtgagaacatgcaatgtttgtctttctgtgcctgtcttatttcacttaacatagtgatctccagttctatccatgttgttgcaaatgacaggatctcattcttttttatggatgaatgccataaaaaatatataccacattttctttatccattcatctgttaatacagcagtccccaacatttttggcatcagggagtagttttggggaagacaatttttccacggatggggtggtggtggggtatagtttgtggatgaaactattctacctcagatcatcaggcattagttagattctcataaggagtgcgtagtctagattcctcacatgtgtagttcacagtagggtttgagctcctatgagaatctgatgccaccacagatctgacaggaggcagagctctggcctgaatgctttttcacccgctgatcaccttctgctgtgcagccggttcctgacaggaaatagactggtaccagtccatacccaggggttggggacccctgtgtaatggacacttaggttgcttccaaattttatctattgtaaacattgttgcaacgtaggagcgcaggtatctctttgatataccagtgtcctatttttaaggtttatacccagccatggaattgctggatcatacggttgctcaatttttagtgttttgaggaaccttcaaacttttctccatagtacttgtactaatttacattctcaccaactgtgtacaagggttctgttttctccacatcctcacaaacatttgttattgcctgtctttggatataagccattttaactggggtgatattacagttctgatttgcatttctctgatgatccatgattttgagcacctttgcatatgcctgtttgtcatttgtatgtcttcttttgagaaatatctcttcaaatattttgcccactttttgattggattattagatttttttctgtggcattgtttcagcttcttatatatttgggttactagtcctttgttagatgggtagtttgcaaatattctctcccattctgtgggttttctcttcactttgttgattgtatcctttgctgtgcagaagctgtttaacttgttgtaatcccatttgtccgtttttgctttagttgcctgtgcttacagggtattgtccaagaaattttggcccagaccaatgtcctggagatttttccccaatgttttgttctggtagtttcatagtttgaggtcttagatttaagtctttataccatatgctttttatatatggcaagagataggctctagtttcattcttctgcatatggatctccagttttcccagcaccatttattgaagaatctgtcttttccccagtatatgttctggtcacctttgtcgaaaatgaattcactgtagctgtgtcgatttgtttctgagttctctgttctgttccattgaactatgtgtctgtttttatgccagtattatgctgctttgcttgctgtagctccttagtataccttgaagtcaggtaatgtcattccttcagttctttttgctttggatagctttggctattctgggtcttttgtggttccatatatattttaattttttttctgtttctgtgacaaatgttactgttattttgagagggattgcattgtatctgtagactgccttgggtaatatggacattttaacaatattgattcttccaatccatgaattgattcttccaatgcatttttggtatcctcttcaatttctttaattagtgttttatagtttccattatagagatctttcacttctttggttaattcccaggtatttaattttatgtgtggctattataaatgggattactttcttaatttcttttttatattgttcactattggcatatagaaatgctactgatttttgtatgttgattttgtatccttcaattttactgaatttatcagttctaagatttttatggagtctttaggtttttccaaatataagatcatattatctggaaacaaggataatttggcttcctcctttcctatttggatgccctttatatctttcttttttcttattgctctagctaggacgttcaggactgtgttcaataacagtggtgaaagtgggcatccttattgtgttccagattttagaagaaagcctctcaattttcccccttcagtatgatactagctgtgggtctgtcatatatggcttttattaggttgagttatgttccttcaatccccaattttttgagggtttttatcatgaagggatcttgaattttatcaaatgcgttttcactgtcaattgaaatgattagatcatttttatccttcattctagtgatatgatgtgtcacatggactgatttgcatatgttgaaccattcttgcattccagggggataaatcccacttggttatgaatgatctttctgatgtactgttgaattttgtttgctagtattttgcaccaacattcactagagatattggcctgtagttttctttgtttgtttttgacatggagtctcgctctgtcacccaggctggagtgcagtggcacgatctcagctcactgcaacctccacctcctgggttcaagtgattctcctgcctcagcctccaagtagctgggactgcaggtatgtgccaacaagcctggttaatttttggatttttagtagcgatggagtttcaccatgttagccaggatggtctagatctcctgaccttggcatctgacagccttggcctcccaaagtgctgggattacaggggtgagccaccacacccggctagttttctttctttttttttcttttcttttcttttctttttttttttttttggtgtgtgtgtctttgtctggttttaatatcagggtaatattggccttgtagaatgagtttggaagtatttccttctcctctatttttcagaatagtttgagtaggattggtattagttctgctttaaatgtttggtagaattcagctgtgaagccatcagaccccaggcttttctttattgggaaactttttattataccttcaataacattacttgttattggtctgttcaggttttggatttcttcccagttcaatctcggtaggttgtatctgtgtaggaattttttatttcttctagatgttccagtttattggcatgtagttgttcatagtagccactagtaatcctttgaatttttgcagtatcctttgaaatgtctccttttcctttctgattgaatttttttgtgtgtcttctctgttttttcttagtttgtctggctaaaggtttttctattttgtttaacctttcaaaaatcaaccttttgtttcatcagtcttttttttattgttttcttcatttcaattttattatttctgctttgatctttcttattttcttctattaattttggttttggtttgctcttccttttctagtttttaagatgcatcattagattatttgaagcttttcctctttttttgatgtaggcacttatagctagacacttcctcttagtattgctttgctgtatcccataggttttagtatgttgtgtttctattatcatgtttcaagaaaattttcagtttccttcttagtttcttcattgaccctctggtcattcaggagcatattgtttaatttccatgtatttgtaaattcctcttgttattaatttctagttttattccattgtggtcagagatgatgctttatattatttcagtttttttcaatgttttacaacttgctttgtgacctaacatatggtctatacttgagagtgatccatgtggtgaggaaaataatgtgtattctgcagctgttggatgaaattttctgtaactatctgatagatccatttggtctatagtgcagattaagtcccatgtttctttgttgattttcttcgaagaaagatctgttcatagctgaaagtgcagtgttgaaatctccagctattactttattggggcctatctctctctttacctctaataataatatttgctttatatatctagatgcttcattgttgggtgtatacatatgtttaaaactgttatatcttcttgctgaattgaccgctttatcattatagagtgaccttctttgtctattcttttgtttttcgtcttgaaatctgttttgtttgatgtaagtatagctactcctattcttttttggtttccatttgcatggaatatatttttccattcctttatcataggctacatgtgtctttatttgtaaaatatgtttattgtaggcaacagattattgagtattttttttccatccattcagccactctcttgattgaagagtttagtctatttacgttgaaagctattattgataagtaaggacttacttctgccattttattatttgttttctggttgttttgtgttcttctcttccttctttctttctgtcttgctttagtgaaggtgatatgattgagtttcttggtttttatttcttgtgtatcttgtttttttgttttgaggttaccgcgagacttgtaaatagtacattataacccattatttaagctgataacaacttgacactttttgtggtcctcttttccttctttctttccctcctgtcttcctttagtgaaggccttttttttcctggtgatatgatatagttttttagtttttattttttgtgtatccattgtatgttttttggtttgaggttaccatgaatcttgcaaaaactaccttatagcccattattttaacctaataacaacttgacactgtttgcataaacaaacaagcaaatgaaaactaataaaaactctataccttaacctcatccatctgctttttaacttgttattgtttgtatttatatcttattttactgtcaacatcttgaaaagttgttattatttttgagtggttcattgtttagtctttctatgtaggataagagtattttactcaccacagttacagtgttataatattctgtgtttttatgtgtactcactgttactggtgagttttgtgttttcaggtgattacttattgctgattaatgtcattttttttttctgtttggagtactccctttagcatttcttttaggacaggtctggtgctgatgaaatcactcagcttttgtttgtctgggaaagtctttatttctccttcatgtttgtaggatatatatacacttcaaatatatacattttaggatatatatacatttcaaatgtaaaagttgttttccttcagcactttaaatatgtcatgccattgtctcccggcccataaggtttccactgaacagtctgccgccagatgtattggagctccattgtatgtgatttgttgcttttcccttgctgcttttaggatcctttctttattcttgatctttgggagtttgattgattactaaatgccttgatgtagtcttctttgggtttaattctgtttggtgttctataaccttcttgtactttgatattgatatatttctctagtttgagaagtttcgtgttgttacccctttgaataaactttctacccttatctgtttcacttcttcctttttaagaccacgaactcttagattttcacttttgtagctattctctaaattctgtagatgtggttcattgtttttaatcttcttcttttgtcttttctgacagcgtattttcaaatagcctgtctttaagctcactaattttttcttctgcttgattaattctgctattaaaagactaatgcattcttccatatgcgaattacatctttcatctacagaatttctccttgataccttttaattatttcagtctctttgttacattcatctaatagaattctcaatttcttctttttgttatcttgcatttctttgagtttcgtgaacacaggtattttaaattctctgtttgaaaggtcacatatctctgtttctccaggattggtccctggtggcttatctatttcatttgatgaggtcatgttttcctggatggtgttgatgctaatagatgttcttcattatctgggcattgatcagttaggtatttattgtagcccccactgtctgggcttgttggtacctgtcctccttgggaagactttctagatgtttgaaaggacttgggacttggatgttatggtattagttgtatctgctataggggggaccctaagcccagtaatactttacttacaaactcatagagggactgccttgatggtcttggacaaggtctgggagaattctggattaccaggcagagactattgttctcttaccttattttctcccgaacaaacagaattcctctctctgttctgggccacttaaagctgggggtggagtgacaaaagtaccaccgtggccatcaccagtatgactgtgctggtcagacatgaagccagcacaacattggatcttgcctacagcctgctgtatgcactcactggttactgcctgtgttcgcctaaagtcctggggctctacaatcagcaggtggcaaagccagctaggcctgtgttcttcccttctggatgacgagttccctcaggcccctggtgggtccagaggtgctatacaggagttagggactagagttaaaaaccttagaagtctacttagtgttctattgtactttggctgagctggcactcaaaacgcaatatgcagtccttcccactcttccctcccttttccaaaggcagaagagcctcacctcatagccactgccatcaaaggccatggggagtactgccagactacagctgatgatcccttaaggcctaagggctcttaagtaagcttatggtgaatgctgcctggcctgggactcaccctttaggggagtgggctcccctctggcctagggtaggttcagaagtgccatccaagagttaagtcctaaaattggggatcccaagaccccacttggtgctccatccacctgtgactgtgttagttcctaaggtacaaggcaaagtaccatttacttttccctgtgcttttctctaacataagagttttgccctttagccactgcagctggtaatgtgctgtgtttcacctgaagccagcaagtctcagaggctcacctaagaccctcaacatagaacgtgggtattgctgctggttattcaggacccaagtactcttcagttaaccaggtgatgaatgcttccaggactgggtcctttccttcaagtcagtgggttcctttctggcccagtatgtgtctagaaatgtcgtctggaagctaagacctggaaggagggcctcatcattctgactggtgccaagacaaagtcctctccacttttcccacacctcttctcaggtggaagttaggggtctcttttggaaccacgatttgtgcagtctggggttagaggagaggcaatgccagtactcccttagtcaccccctctgctgtcccagcaggtcctgtgccctccagttcactgtttctgggcccagttcagcactaggacttgcctaagagttgtagtccttatggcccagactgcctttcaacttcatttaaagactcagagcattttagcccttggtggtgaggtcagtgggaactgaagttcagactgctaggattggcgattttcctttgtctagtgctggtttgtatgtgccttctgtaggcgggtgtcccctgagttttgttcagttctcctttctactatagcaggacagcagtgagttcagtccctcacgattattgttttctccctcctttagtgcctagagatactttcctccccgtatactgccactgcagggaggtgggagagggctgatgttggcaattggagaatttttaagaaatcacttcagtgcctctttcactgatagaagttaacaccaggtactatgagggctcacctgatttttggttttatgaaggtgttttttctgtttagatagttgttaaattgatgtccctgttggaggggacgattgatggaaccttctattctgctatcttgctctgtgtctctatcacctttatctatttcttaaacattttttatcatcccaaaaggaaactccgtactcatgaaggagtcaccccagcccctggcaaccactgctctgctatctgtctttacaaatttacttatattctagatatttcatataaatggaatcacagtatgtaacatcttgggatttccttctttcactaaatgttatgtttttgatgttcattctcattgtagcaagtaccagtacttaatacctttttacagctaaataatactgtggttttgatttccatttccttaatgattaaatattgaatatcttttgatgtgcttgctggcccttgtatcttagtttggagaaatacttattcaagtactttacctgtttaaagaaactttgttttcttaaattttggaaaaatatgcataatataaagtttaccattttaaacatttttaagtatacagtttagtggcattaaggacatgtgcattgttttgccaccatcattttcattcctctttaaaactttttaatcttgtaaatctgaaactctataaccattaaaaaatagctacccactcccccacctccttccagaccctaagaactgccattctactttctgtttctgtgaatttgatggctatagatacctcatgttaagtggaatcatgcagtttttgtcctttggtgactggcttatttctcttagcataagccttcatggttcattcgtatgatagcatgtatcagactgtctttcctttctaaggttgaataatgtttcattatgtattagtacattcacaatgttgtacaactgtcacctttatctagttcttacacacatcatattttatctatctatttattcattgatggacacttgagttgcttccaccttttggctgttgtaaataatgctgctaagaatatagcttacaaatatctttgtgagtatttgtgtcttttcatatgctttttagccatttctttatcttccttggagaaatgtctattcaaatcttttacttattttataattgggctttttttgctgttgaattgaaaaagttctatatatcttctagatatgaggctcgcatgagatatatgatttgtattttccaccattctgtaggttgtgttcacttttttgatggtatcctttaaaacgcaaaagtttcaattttgatagtttatctatttttttattttgttgcttatatttttggtgtcatatctacaaatccattgccatatgtaacatcacaatgattatttttttgccaacataggtaaaagtaatatatgaatggctctattagctccaaaatgttttaaattattatggtaagttttactattctaacaggcagagtgcttttaggaatatgttcccctttaaggataatacttctctgctaggttgaagacaagtttagttatttcacattaatttttgttactgacgtgatacatttgacaagccaaagtaaaggcaatgaaaaattaaatagagtgaataatagatgcctgttgtattcactgttatactttctccggtagtttatgaaatttttaaataattctttaagagtttccgtgtttcttaaagttggcaggaaatattttgctgtctatgacttttatatggtgatgtgatgggtaaaagtcatttttattttttggggccacattagctacctaataataaacaataagtcacatctgatgaattattttaatgtagtaatgtctaaaatcaatttataaagcatggaaagtaaacatttattactattctttcatttttagttcactttattgggaaaagctcatttttaaaactagtaaatatacttattaaaattcaaagtgcatgccgatattaagggaaagtaggaaataaatttatatttgactggcaaagctttaaatatactgcagcatatatattattttaaaaatccaacctaataaagccaatctaacattattgtcaattattattatattatggttagtcagttattataagttactcttaaaatgttttattaaaattttatttataatgttcaggaagattctctgattaaaaacttgctttggagatatgtatataaaatatttatgtgtgtatatgtatactatatatatatgtatatgtaatctttgtggctatggaaaaatataacaatgttaaatgcttgggctttggaatcataccacttgagtctacatgctggcaatgccactgtcaccttggataaattatttaacttttaacttaattttattttttgagatgcagtcttgctctgttgcccaggctggagtgcagtggtatgatctcagttcactgcaaccccagcctcccgggttcaagggattctcctgcctcagccttcctagtagctgggacgacaggcacgcgccactgcacccagctaatttttgtatttttagtagagatggggtttcacatgttggccaggctggtctcagactcctgacctcaggtgatccacctgccttgacctcccaaagtgctggaattacaggcatgaggcaccgcgcctggcctatttaactttttagtgtcttagttttctcatctgcaaaatgcagctaatttaatttatgttgtaatggtaagtcataaatgtggtactttatatgttgtataatatatgttcctggcaaatgttaactccctaatcctagctattattgtgatattattattactattcataacatcaataagtttagtattttgataaaaatatatgattcaaacttttatggcagtattatttttgtcatattatttccaatctgacttataaactgtagtaaaagaaactaaattaatatttagttgaatagaagaatggctcagtacattacacattatgttatttgcaatgaaggaatatccttgaactccataaatacttattgaatgcctaataaatgcaaggaacaatgttaggacttgaatttatatacattgtgtgggtgctattatagtgttatgaagaaattgagtgatagaattagtgacaaagagatgaattctcattgaagaatctggtcttggaaggtctttcatttcttcaatatttaaaaaaataattggatatataatagttgtacatatttaaggggtacatgtgatattttaatacaaatagataatgtgtaatgatcaaatctgggtaactgaaatatccatcacctcaaacatttatcatttctttgtgttgtgaatgctccaagtctactcttctggatcttttgaaatatacaataaattattttaaactatagtcactttattatgctgtggaacactagatcttattctttctttctaactgtatttttatacccattaaccatttctatttatcctcatctcctcactagtgttcacagcctctagtaaccaccatttcattcactacctccaggagatcaattgttttagctcccacatatgaatgagaacatgagacatttgtcttttgtacctggcttatttcacttaacataatgttctctagttccatcagtgtcattgcaaatgacaggatttcattctttttaatggtggaataatgttccatttgtgtatatataccacattttctttcattgttcatctgtcgatggacacctaggtggattccaaatcttgcctattgcaaataatgctgcaataatcatggatatgcagatatttctttgatatactgattttccttcttttggatataaccagtagtagaatttctggatcatacgtagttctgtttgtagtgttttgaggaacttccataaacctccatactgttttccatagtggttgtactaatttacatcttgaccaacagtgtgtgagagcatgcccctttttctgcatcctcaccagcatttgttatattctgtcttttggataaaagccattttaactgtggtgaggtgggttgcatttccctgattattactgatgttgaacattttttcataaacctgttggccatttataagtcttcttttgagaaatgtctcttcaggtctttagcccaatttttaattgtattattattattattttgctattgagttgtttgagctccttatgtgttctggttattaatcccttgtcatatgagctatttgcaaatactttctccccattctgtaggttttctctttactttgttgattgttagctgtgcagaagcattttagcttgatgtgatttcattttttcaatattactttggttacatgtgatttagaggtcttactcgaaatctttgcccagaccaatgttctgtagaatttcctcaatgttggctgggcacaatggctcacgcctgtaatcccagcactttgggaggctgaggtgggcagatcatgaggtcaagagattgagaccatcctggccaacatggtgaaaccccatctctactaaaaatacaaaaattagctgggtgtggtggtgtgcgcctgcagtcccagctacttgggaggctgaggcaggagaatcacttgaacccgggaggcggaggttgcagtgagccaagattgcgccactgcactccagcctggtgacagagcaagactctgtctcaaaaaaaaaaagaaaaaaaaaaaaaaaaaagaatttcctcaatgttttcttctagtggtttcaaagtttcaggtcttacatttaagttttaaatctattttgttttaatttatatatatcttgagagttagggggtctagttccattcttctgtatatacaggatataattttctgagcaccatttattgagagactattcttgccccagtgtatgttcttggcaccttctttgaaaatgagttgtttataagtgtgtgggtttatttctggcctctctattctattggactatttgtctttatgccagtatcatgctgttttgtttgctgtatagctgtataccataattcgaagtcaggtaatatgctgcctctagctttgttctttttggtcaagattgctttggctattctgagccttttatggttcaatatgaattttaggatttttttttccatttctgagaagaatgtcattggtattttgataaggagtgcatttaatctgtagatacctttgggttgtatggatattttaacaatatttgttcttccaacttatgaacatgatatatattttcttttttgtgtccttttcaatttctttcatcagtgttttatagttttaattatacagagcttttactactttgattccatttattttatttgtagctattttaaatgggattactttttgatttttcagattgttctctgttgccatacagaaatgctactgaatttatatgtcaattttgtatcctgcaggtctactgaatttatttattagttctaataggtttttggtggagtctttaggttttttgaagtataagatcatatcatctgtaaacaaggataattttactttctcctttcctgtttggatgctctttatttctttcttttgcctaattactctgggtgggacttccagtactatgtctaataaaagtggtgaaagtgggcgtctttgttgtattccagatcttagaggaaaggctttcagtgtttccctagtcagtatgatgccagtggtgggattgttttatatgacctttattgttttgagttatatttcttgtatccctagttttttgagagtttttttttaaatcattaagggacgttgaatttcattgaatgctttttcaaccattgaaataatttttgacctttattttgttatatgttatagcaaatatgctatattttgttaaatgcgctatgatgtatcacatttatcgatttgtatgttgaactatcttgcacccctgagatgaatcttacttcattacgatgaatgatctttttaatatgttgttgaaatcagtttgctgaattttgttacagatttttgcatcttgttcatgagtgatattggcctgtagttttcttttcttgtgttttgttttgttttgttttgttttgtttgtgtttttgtttttaattgtgtctttgtctagttttggtatcaggataatgctggccagtaggatgaatttgagagtgttctctcatccttgactttgtagaatataataagtagaatttgttagttcttctgtaaatgatttgtagaattcagcagtgaaactatctgatattgggcttttctttgatgggagtctttattattgtttctgtttcataacttgctattggtctgtttagtttttctgtttcttcatggttcaattttggtagtttgtatgtatttaggaatttatacttgtctcccaggctttacaatttattgggatatagttgcttatcatagtctctaatgattctttgaattcctgtggtatcaattgtagtgtctttttttcatttcttaattatgttcatcttctcactttttttcttagtgtagctaaaagtttataaattttagttattttttcccaaataacttctccttttgttgatcttttatatatattttttagtctataacttattcatttgtgctctagtctttattagttcttctcttctcctaagtttgggtttagtttgttctgcttttttattttctaagatgcactattaagtgttcttatttgaaatcttttttgatgtaggcaacattgtttttgtggtgtcccataggttttggtatgttgtgattctatttttatttgtttcaagccattttaaagttttattcttaatttcttaattgaaatttaatgttttcattccttcagcagcgtattgtttcatttccatatatttgtatagtttccaaagtgtcattattcatttctagttaattccactgttgttagaaaaaatacttgatactctctttgggaggccgaggcagctggatcacctgaggttgggagttcaagactagcctgatcaaaatggagaaaccctgtctgtactaaaaatacaaaaaaattagctgagggtggtggcacatgcctgtagtcccagctactcgggaggctgaggcaggagaatcacttaaacctgggaggtggaggttgtggtgagccgagattgtggtgccattgcactccagcctgggcaacaagagcaaaactctgtctttaaaaaaacaacaacaacaaaaaccaacttgatattattttgacatgtaatactttgttgagactatcttcctggcctaagagatggtctgtcctcaagaatattccatgtgctaatgagaagaatgtatatttttcacccgttgaatgaaatgttctcttattgatcattaggtccatctggtctgtagtgcatattaagtctaatggtgcattgttgattttctatttaaaatatatgttcagtgttgaaagtgggtgttgaagtccccaggcattattatattggagtctgtctttctctttaggtctagtaatgtttgctttatattatctggatgctccagtgttttgtgcaagaaatatttgcaattttaatattctttggctgaatttgaccattttattattatataatgaccttctttgactcttcttacagtttttgccttgaaatctattttatctgacataggtatagctattcttgttttttgtttccatttgcatggaatatttcatttcatttccttcatttttagtgtatgttgtttttatagctaaagtaaatttcttatgggcagcatatatttgagtcttgttttaatccattcagccactctctgtcttttatttgaagaatttagtccatttacattcagtgttattgttgaaaggttaggacttaactacttccagtttgtcatttttcttctgattgttttgtacattttctcttcctttcttcctctcttcctttttagattagtgatttcctctggctgtatgttttaattccttgctttttattttttcaatttctattataggtgtttgctttgtcattactgtgaggcttgcaaaaatattttatagctaacaacgttaaattgataaaaactctaatctcaaagaagagggaacaaaaggaaaacaagcaaagaaaaaactaaaaaattctgtactctaacttttcctctaactccctcctactttttgactttttgttgtctctatatcttttcatattgtctatctttcaaaaattgttgtagttattatttttgatagatttttcttttggtcctcatgctgaaaatgtaagtgatttacacaccacaattgttgcactagagcaagcttgtctaacccgcagcttgtgggccacatgcagcccaggacagctttgaatatggcccaacacaaatcagtaaactttcttaaaacattataatttttttttagctcatccactatcattagtgatagtgtgttttatacgtggcccatgacaattcttcttctaatgttggactcttctgttagagtattctgaatttgtctttgttcttaccttttccactgaatttcatgctttcagatgttttcttgttatatgttagcagcctttactttcagattgataaaatctcttcagcatttttttttgtaaaatctcttcagcattcatctggtgatgatgaatttactcagcttttgtttgtctgggaaagtctttatttctcctccatattgaaggatatctttcctgtatgcagtattctaggttggaagttttttccctttagcacttttaatatgctatcttgctcattctggtctataaactccccactgagaaggctgctgccagaaatatcagagctcctttatatgttatttacttttttcttcttgttgcttctaggatgattctttcatctttgacctttgatagtttgattattatatgtcttgtggtagtcttatttcagttgaatcttcttgatgttctttcaccttctttacctaaatgttcgtatctttttctaggtttgaaaagttctcttattactttctttgaataaactttctaccccggtctttttctttgtatcctctttaagaccagtgactcttagattttcccttttgaggctcttttttagatcctgtaatcatattttattcttttttattcttttaaatctattttcatatagtatgtcttgaactaaatatttccgtttttgcttgatcaattttgtttttgagagattctgatgaatttttcagtcagttgactttttcagctcgagtgattttttattgtttatttcagtgtctttgttaaatttctctgttttatcttgaaatgcatcatgttttctcaaaacaggtgtattgaattctttgtctgagaatatatgtatctgccactctagaattggtcatgggtgcctcatttactccgtgtgatgaggtaatgttttcctgaatgctcttgatgcttgtggacatttgatgatatatgagcgttaaaaatttaggtatttgttccagtctttccagtctggcattgtttatacctgtccttgagaaagttttctgagaattcaaatgggattgagtgttaaattacttatttctgtggtccttgcagttgttttagcactagagggagccctaagcccaggtatgctgtactcttgcagactctaggtacatagcctgggtagacttctgaaagtgaagggagaattccttttgttatcaggcaaagtccctttctgtcttttccagaagcataaggagcccttctctaccctgaactgtctggagttggggaacgggtggcatgggcactttttatgtacatatttgtttatccaattatttgtaaaacaaaagatgtactataagaaaaatatgtcttcaaatcatgaaatatacagacattaaaaaaaattccaatcctatataactaatagtttcctccatttaggtcttactcttttgggttaagtttattgcaaggtgcttaatgggttttgttggtattatgaatacatttttttcctttaatattacatttgtaattggtaatgtctgtttttatatctgttatgtttttagttcattttgttgatctttttataggtttttgaatagtaggcttatctgattttcttaatttctctctatattttaagtttttaacagtgataaactttaatttttcagttttggggaaaaaagagttctttcaacataatgacagttctatttttaccttatgtttctctttttggcatactgtgactatctgttcatagcagacttttacagacgtgtttaatactttaatacacacactaggatgtgacccaaacattctctgagactcaagggtagtaaaaaggaagatgaattacctttttttctctcttctaagatgaggaaatttttcattttaaaccattctcacacattgtagattattcagagaagcagaaaatttattaccaaatgaggttgagcatttcttaaaataagtgtaggaagcttaattctctcaaactaggaacattgaaaaatctcaagctgcagatacatgaaaatagcttgagatggaaatattggttctatttattcttttgacacaacaatgttaaaagtttgtattctctcagtacatactacgttctgtgttgcacaggaaagccaacttgagattttgaatattccaaagagaggccatccttttgagctgttttcattctttttgttttcataaaaggaatttcaaaggtgaggagaactgaggctatgaaaactgtttggccctgatgtcagatattttagcatgccttcattatgggttactggaatatgcagtttattacttatttctgttagatgcttttaaaaagaactatctgtgggctaattcccaaagttcccctggggaactttgccatggctttatcaaacctactcccttcctcaggatctcttcttctaatttttatttgtacaaagttttatgttctacctcttcaaactttgactaagcattacttcaacttttgctatttgaatagtgatttttaggcccttagatctgatgttatagaatatcttcacctctggtttacaagtttttgacaatgaagtgtgtcatttacttgctttcttttcaggaacaagtggactaatatatctctatgtaattttgaaaactattcaatagtttcagttctgtaggtagaatactatttatttggggccagagagaaactattattttgtctaagggttcaatatttctctttaattttatttgatgtgatgcttagcccctataatgtattgcttgaggtttgcattacaagaatatggcactatttggttttttaaaaagtgatataagatgttatgattgaacttaataataaaaatggttcttatgccaactcacaagtgttgtagaattcctactggcttgaaatgacaggcctagggtgaagaaaagataaatttaaagtggggcatagttctacttatattctaatacgtataaaacatttatttagtacagttcagaagattataggttaacctaagaaactttaaacatacttttggttttattctgatatttgtacaattttttcaaaaggcaaaaccaaactaaattccaatttggacacacacttttgcattgctcaaatagtgcatgaatactaattagtgatggtggagaagttaattatattttagtcatgcctacagcaggtgtaggaaagcttcagcataaatattgtttataaatatttcataaacacattaaaatcctccttaatatattatttaggaagaagtgcctttctctcaaagacccatttttatatgccataggacatggatccaaatatttacttttctcttagttacacatacttttatctatatcttttatcttacctttactttatggccaatttattgattttatagtaataatttatgtttttaggctttaaaggaagtatataaacatttaattatatatttgcttaacagtacagcctattttattaggcaatttaaaatttttaactttctgctgaacatttccaaagtcccactactatacaaattaattagttaagaaatggaattcattgtcgttattattttaaatatattctctctccatccctatcttagttaatgatactatcactcttttaggctcaatttcaaaagcatcttcttattccatcttttccctctgccagtatattcaattccaaactgatcctggctctgcactatctatgatatttattcccttcttggagttcattgcccttattagtttaggcctccatgatcctgcttctcttgtgttcttgttagatgttacagattacctgacatgatataagttctcattaaatatttgttgaattaatgcatgaatgctctcactatgtatttatagactctctccatttacaatccacctttatacttccttcataggaaaagaaaaaagagacaattttcttcctaaaatcattcaaaaaacttattttgttactatttctaaaatatttgttgcctgcaaattatctatgaagtacatttaaagctcctttataaggcttgtaaatccttttatactgagcccagataacttttcttgctttacgtcttaccatatttttcatattctatcatatctttatttttttattttttgcaatttacattttactcaataatacattttccttgtcagttaagctccaagcattatatctaaaaatgtggataatgtttattgattataccaggtacattgctaaaaagctaatctaaatgtttttcgattaattctaagcatttaataaagattttagtatacctattttagttattatttattatacctattttacaaatgagtaaaccaaggacataagcctaactcctttttgaaaggttaagtcattaagtgctagaatgagaattgaaaccttgaactacctgattctaacagtggtctaaaccagtatgttcttatattttctttgactctcacatgcaactagtggccagctcttatccattttaaggccataatattgcacatccattgtcctacttatgtctattattatttagccttgactgttacattagcttctaaacagatcttttaatcagtattttattcagtttccaagacttccacaatattatatagtttttacttcatatccaaccactcctccctataaacccaggtctttgcctatttaaatgggtgttatgtccctgcctttgaactcaaattactcatttttcaaatctcagctccaataaaattccagcctaaaaacttgtcataatatccccactaacttcaggcaggtttgtgcctccatgattattaccatcagtgttcttgttaagtcataatttacttgtctttttatctagcaggatgtgaacatctttatgagagaatttttgtctcatatgttttgtagttttttacattcttgtatgctcactattaggtagtactgtacttggtacatagttagaattttgctgtattaatattactacaaagtaacatttgtttcatctgttttaatcatttttatattatcgaaaagaaaatattatttagtcttcctagcaaacgagttttctagtttcaactaatttttactttacaggaagaggcaaaaagtagcttcctgtttttaaaattattgattattctgcttgcttttattttcagcaattgggccaacagtgaaataacactggcagttccaatgtatgtattatatttgctctgaatgagaattggttttaattattatagatgatttcccattctcataactcttattgagcaataatgcaatattttatatataaattttttcattgaagactggtaagagaagttatgtaaagctcaaataaggaagaaaatgcaatttatgtaactctcttcagtttctagtttttctagagaagataaatagaatcttgatatctgacttttcagagcttaactatcttacattttgactcactaacctattaattctggagtcattttagcagaatgtattattctatacaataagttactagataacttcaaagtactaatatttcactttaccataacatatgtattttatgtgatttttaacatacattttgtgcattcttctagctgtaagcgtccaacttctggaatttcaaagtagtataagactatgtaactcccattatttgtaacagaagatatttgagtaattattcacatatgatattttatatattttaaaaattaagcactagtgttttcttgacaaatggaataatcgtttatttcatatattcctaacaacatcccaatacccaaaaagaaaaaaataactacccttaatatatgtaggaaaaacaaagaactcttcaaataaagttgttacacataatgttattattgatttacaagtcaaaagaataaaaatgcattttattgtctatttctaagtgtagaaatgtttagtatttataaaatggaaaagttctatttaatttgtttgttttgacataagtccatgtgaaagagctataaagaaaatacaaacagttcccccaaattgcctttctctcttcatggctttcagttaaacattgtaaacttaaggtctctttaccccttaaatactttagtgcatatttcttaaaaactaggaattctcttaaccacagtataattattgaaatcagaaacttaacattgatgcatattgttattaaatatagattttattcagattgtgccaattgtctcaatgttgttttttaaagcaaaaaaaaaatccgattattagttgtgttcatttttgaggccttcttagtcttttttttttaaaaaaaaatttattttactttaagttccagatacatttgcagaatgtggaggaggtttgttacataggtaaacgtgtgccatggtggattcctgcacctgtcttagtctttaacctgggtaatttcccaactctttcattttgtttaatgtcatttgacattttttaggactacactatattatttttgtgtatggatagaatgtgctacaatttgtgtttgctatgtcttcatgattatgttctgattatgcacttttggcaggaatacctctgaagttatgttaaattcttaccaacgtatcaggagccacatgctgtcatcatgctcttaatagggatgctcacaatgaacctttggttacagtggtgtctgccagacttcatcactgtaaaggtgctattttatcctttacaatgaatgagaatcttatgggagatactttgagactatgtgcatgttgtgttagtcctcagtctttcacccgctagttctaacatatattgatagttcttctgtaatcaatgattattatgatttttaccaaatggtgattttctaatttctttattctttccacattgattagttggctttctactataatgagaagcttgcttttctctcttttgtctacctgtctatgtatgtatgtatgtatgtgtgtaatcctttcattctttgagcatttccttatagtttcggcatttatcttgtacttttccagccataactgtggaagctagcatttatcaagcagctttggtacttttagtgggctctgagcatcattgtttgtggatcacctcagcagacaaactagagaatacatgtatgtgtacagaaatgcttacataggtgtctactcacagacacatgtattttcatacatatgcacaacctcacctacatcaatattcatttcttccttcttcacaatcctttaaaaatgcaataacattcttagcttgagaatcatagaaaaattggacatgggctggatttggaccccatatcatagtttagtgacccttagaatatatggtttgagtttcctctcattttttaatgtggtatacaatgttggactgtaaaatgtaaattttatagcactcttggccctttgagtctccaatttataacttaaatttttgaaacagtgctattttctggaagattccagttacttaaggtttaaattattgtttatgatcatgttcacgtactggagcactgctttgaaaacattcagtaagtactggatcaaagaatgaattactttaccttttttatcgaagaaagaatcatttcttgttttcccactctttaatataggcaagtacaggtgcctaatatcctaaataaacaaagtaatctgattaagtcatatggccttttctaaattgcaagagctatcatgtatccaaaagaaaaaaaaatttacacttctcataacagcaggttaatatatggcaatggttgtaaatctagggcttttttgtgagaaaaatcagatagtgaagatattgatatcagcatttcatatttatttatataaaaaagaaacagctatattgttttcctttttcataaactataaattgatgaaaatttgggcttagagctataaataaaaatgtaagttaaaaaatagaatgaaaatttatttttcatatttttaattgaccagtgaaaattatgtatatttataatatacaacatcatgtttggtttatgaggatatattgtggaatgcttaaattaacttaacatatttatcacctaacatacttatgattttttgttatgagaacatttaaaatctgctcagcggtttacaagtatgcagtacattgtttttttttttttattatactttaagttttagggtacatgtgcacattgtgcaggttagttacatatgtatacatgtgccatgctggtgtgctgcacccactaactcgtcatctagcattaggtatatctcccaatgctatccctcccacctcctcccaccccaccacagtccccagagtgtgatattccccttcctgtgtccatgtgatctcattgttcaattcccaccaatgagtgagaatatgcagtgtttggttttttgttcttgcgatagtttactgagaatgatgatttccaatttcatccatgtccctacaaaggacatgaactcatcattttttatggctgcatagtattccatggtgtatatgtgccacattttcttaatccagtctatcattgatggacatttgggttggttccaagtctttgctattgtgaatagtgctgcaataaacatacgtgtgcatgtgtctttatagcagcatgatttacagtcctttgggtatatacccagtaatgggatggctgggtcaaatggtatttctagttctagatccctgaggaatcgccacactgacttccacaatggttgaactagtttacagtcccaccaacagtgtaaaagtgttcctatttctccacatcctctccagcacctgttgtttcctgactttttaatgatcgccattctaaatggtgtgagatggtatctcattgtggttttgatttgcatttctctggtcagtgatgatgagcattttttcatgtgtcttttggctgcataaatgtcttcttttgagaagtgtctgttcatgtcctttgcccactttttgatggggttgtttgtttttttcttgtaaatttgtttgagttcattgtagattctggatattagccctttgtcagatgagtaggttgcaaaaattttctcccattttgtaggttgcctgttcactctgatggtagtttcttttgctgtgcagaagctctttagtttaattagatcccatttgtcaattttgtcttttgttgccattgcttttggtgttttggacatgaagtccttgcccatgcctatgtcctgaatggtaatgcctaggttttcttctagggtttttatggttttaggtctaacgtttaagtctttagtccatcttcaattgatttttgtataaggtgtaaggaagggatccagtttcagctttctacatatggctagccagttttcccagaaccatttagtaaatagggaatcctttccccattgcttgtttttctcaggtttgtcaaagatcagatagttgtagatatgcggcgttatttctgagggctctgttctgttccattgatctatatctctgttttggtaccagtaccatgctgttttggttactgtagccttgtagtatagtttgaagtcaggtagtgtgatgcctccagctttattcttttggcttaggattgacttggtgatgcgggctcttttttgattccatatgaactttaaagtagttttttccaattctgtgaagaaagtcattggtagcttgatggggatggcattgaatctgtaaattaccttgggcagtatgggcattttcacgatattgattcttcctacccgtgagcatggaatgttcttccatttgtttgtatcctcttttatttccttgagcagtggtttgtagttctccttgaagaggtccttcacatcccttgtaagttggattcctaggtattttattctctttgaagcaattgtgaatgggagttcactcatgatttggctctctgtttgtctgttattggtgtataagaatgcttgtgatttttgtacattgattttgtatcctgagactttgctgaagttgcttatcagcttaaggagattttgggctgagacaatggggttttctagatatacaatcatatcgtctgcaaacagggacaatttgacttcctcttttcctaattgaataccctttatttccttctcctgcctaattgccctggccagaacttccaacactatgttgaataggagtggtgagagagggcatccctgtcttgtgccagttttcaaagggaatgcttccagttattgcccattcagtatgatattggctgtgggtttgtcatagatagctcttattattttgagatacatcccatcaatacctaatttattgagagtttttatcatgaagggttgttgaattttgtcaaaggctttttctgcatctattgagataataatgtggtttgtgtctttggctctgtttatatgctggattacatttattgatttgcgtatattgaaccagccttgcatcccagggatgaagcccacttgatcatggtggataagctttttgatgtgctgctggattcagtttgccagtattttattgaggatttttgcatcaaggttcatcaaggatattggtctaaaattctcttttttggttgtgtctctgcccggctttggtatcagaatgatgctggcctcataaaatgagttagggaggattccctctttttctattgattggaatagtttcagaaggaatggtaccagttcctccttgtacctctggtagaattcggctgtgaatccatctggtcctggactctttttggttggtaaactactgagtattgccacaatttcagctcccgttattggtctattcagagattcaaattcttcctggtttagtcttgggagagtgtatgtatcgaggaatttatccatttcttctagattttctagtttatttgcatagaggtgtttgtagtattctctgatggtagtttgtatttctgtgggatcggtggtgatatcccctttatcattttttattgtgtctatttgattcttctctctttttttctttattagtcttgctagcggtctatgaattttgttgatcctttcaaaaaaccagctcctggattcattaattttttgaagggttttttgtgtctctatttccttcaattctgctctgattttagttatttcttgccttctgctagctttagaatgtgtttgcccttgcttttctagttcttttaattgtgatgttagggtgtcaattttggatctttcctgctttctcttgtgggcatttagtgctataaatttccctctacacactgctttgaatgcgtcccagagattctggtatgttgtgtctttgttctcgttggtttcaaagaacagctttatttctgccttcatttcgttatgtatccagtagtcattcaggagcaggttgttcagtttccatgtagttgagcgattttgagtgagattcttaatcctgagttctagtttgattgcactgtggtctgagagatagtttgttataatctctgttcttttacatttgctgaggagagctttacttccaagtatgtggtcaattttagaataggtgtggtgtggtgctgaaaatgtatattctgttgatttggggtggagagttctgtagatgtctattaggtccacttggtgcagagctgagttcaattcctgggtatccttgttgactttctgtctcgttgatctgtctaatgttgacagtggggtgttaaagtctcccattattaatgtgtgggagtctgagtctctttgtaggtcactcaggacttgctttatgaatctaggtgctcctgtattgggtgcatatatatttaggatagttagctcttcttgttgaattgatccctttaccattatgtaatggccttctttgtctcttttgatctttgttggtttaaagtctgttttgtcagagactaggattgcaacccctgcctttttttgttttccatttgcttggtagatcttcctccatccttttattttgagcctatgtgtgtctctacacgtgagatgggtttcctgaatacagcacactgatgggtcttgactctttatccaatttgccagtctgtgtcttttaattggagcgtttagtccatttacatttaaacttaatattgttatgtgtgaatttgatcctgtcattatgatgttagctggtgattttgctcgttagttgatgcagtttcttcctagtctcgatggtctttacattttggcatgattttgcagcggctggtaccggttgttcctttccatgtttagtgcttccttcaggagctcttttagggcaggcctggtggtgacaaaatcggttagcatttgcttgtctgtaaagtattttatttctccttcacttatgaagcttagtttggctggatatgaaattctgggttgaaaattcttttctttaagaatgttgaatattggcccccactctcttctggcttgtagggtttctgccgagagatccactgttagtctgatgggcttccctttgtgggtaacccgacctttctctctggctgcccttaacattttttccttcatttcaactttggtgaatctgacaattatgtgtcttggagttgctcttctcgaggagtatctttgtggcgttctctgtatttcctgaatctgatcgttggcctgccttgctagattggggaagttctcctggatgatatcctgcagagtgttttccaacttggttccattctccccatcactttcaggtacaccaatcagacgtagatttggtcttttcacatagtcccatatttcttggaggctttgctcatttctttttattcttttttctctaaacttcccttctcgcttcatttcattcatttcatcttccatcgctgataccctttcttccagttgatcgcatcagctcctgaggcttctgcattcttcacgtagttctcgagccttggttttcagctccatcagctcctttaagcacttctccgtattggttattctagttatacattcttctaaatttttttcaaagttttcaacttctttgcctttggtttgaatgtcctcccatagctcagagtaatttgatcatctgaagccttcttctctcagctcgtcaaagtcattctccatccagctttgttccgttgctggtgaggaactgcgtccctttggaggaggagaggaactctgccttttagagtttccagtttttctgttctgttttttccccatctttgtggttttatctacttttggtcgtcgatgatggtgatgtacatatgggtttttggtgtggatgtcctttctgtttgttagttttccttctaacagacaggaccctcagctgcaggtctgttggaataccctgctgtgtgaggtgtcaagtgtgcccctgctggggggtgcctcccagttaggctgctcgggggtcaggggtcagggacccacttgaggaggcagtctgcccgttctcagatctccagctgcgtgctgggagaaccactgctctcttcaaagctgtcagacagggacatttaagtctgcagaggttactgctgtctttttgtttgtctgtgccctgcccccagaggtggagcctacagaggcaggcaggcctccttgagctgtggtgggctccacccagttcagttggagctccctggctgctttgtttacctaagcaagcctgggcaatggcgggcgcccctcccccaggctcgctgctgccttacagtttgatctcagactgctgtgctagcaatcagcgagactccgtgggcgtaggaccctctgagccaggtgcgggatataatctcgcggtgcgccgttttttaagccggtccgaaaagcgcaatattcgggtgggagtgacccgattttccaggtgcgtccgtcacccctttctttgactcggaaagggaactccctgacccttgcgcttcccaagtgaggcaaagcctcgccctgcttcggctcgcgcacggtgcacgcacccactgacctgcacccactgtatggcactccctagtgagatgaacccagtacctcagatggaaatgcagaaatcacccgtcttctgcgtcgctcacgctgggagctgtagaccagagctgttcctattcggccatcttggctcgcagtacattgtttttagctacagtcaccatggctgtagatctccagaaattattcttcctttctaacaaaaactttgtacattttgaccatctcctcatttcccatccccttttccacaccagctcctggtaaacatcattctaactctctgcttttgtatattcgattctatttttttttttttttgaggtgaattctcgctcttccgcccaggctggaatgcagtggtgtgatcttggttcactgcaaccaccgcctcctgggttcaagtgattctcctgcctgagcctcctgagtagctgagattacaggtgcccaccaccacgcctggctaatttttgtatatttagtagagacggggtttcaccatgttggtaaagctggtcttgaactcctgacctcaggtgatctgcctgccttggcctcccaaagtgctgggattacatgcataagccactgcgcccagccgtaaatttgagattttagatactgcatacgagtgaaatcatacagtattagtctttttttaacctggcttattttcacataaaataatatcctctaggttaatccatgttgttgtaaaacaccggatttgcttatttttaaggctgaataatatttcatttttaaatatatatattataaatactatgtatataatgtggagaaaatatgggggatggaggattctgtgatgaggataggggttgtgtgagggggatggggtaattctttgaaggggattggggttctgtgagggggaagggggttccatgaggggatgggggttctgtgaaggggataggattctgtgaaggcgatgggattccgtgagagggatgagggattctgtgagcgggattggggttttgtgagaggatgaggcttgaatgagttgatcacttttgtgtagtattcatccattgatggatatttaagttgattttgtatctttgctagtgtgaatactgctgcagtaaacatggggagtgcatatatctctttgaaaattgatttcattttccttggatatatatacacagtagtgggatttttggatcatatgaaaggtccattttcagttttctgagtaaactgcatactacattccataatggccttattaatttacattccccccaacaatgtacaaaggttccctttttttccacatcctctctaactcttgttatcttttgtcttcctgataacagccattctaacagatgtgaggtggtatctcactatggttttaatttgctattccctgatgataaatgatgtggaatatcttttcctatatttattgaccattttttaatcttttgagaagtgtcttttcatgtcctgatatggtttggccatgtccccacccaaatctcatcttgaattggagctgctgtaattgccaggtgttgtgggagggatctggtagaagataattgaatcacaggggtggatctttcccatgctattcttgtcatagtgaataagtctcccaagatctgatggttttataaaggggagtttccctgcacaaaatcttttatcttgtctgccaccatgtgagatgtgcctttcacattctgccatgattgtgaggcctccccagccatgtggaactgtaagtccattaaacctctttcttttataaattgcccagtctcagtatgtctttatcggctgtgtcaaaatggactaatacagtaaattagtaccagtagagtggggcacttctgaaaagatacctgaaaatgtggaagcaactttggaactggttacaggccaaggttggaacagtttggagggctcagaagaagacagggaaatgtgggaaagtgtggaactccctagagacttgttgaatggctttgactaaaatgctgataatgatatggacaatgaaatccaggctgaggtggtctcagatggagatgaggaacttgttgggaactggagcagaagtgactcttgttacgttttagcaaagagactggcggcattttgcccttgccctagagatttgtggaactttgaacttgagagagatgatttagggtatctggtggaagaaatttctaagcagcaaagaattcaagaagtgacttgggtgctattaaaggcattcagttttaaaagggaaacagcataaaagtttggaaaatgtgcagcctgacaatatgatagaaaagaacatcccatttttctgaggagaaattcaagccagctgcagaaatttgcataagtaatgaggagctgaatgctaatcaccaagacagtggggggaaatgtctccagggcatgtcagggaactttctggcaggctttccaaccacaggccaggaggcctaggaggaaaacattttttgtaggccaggcccagggtccctctgctgtgtccagtctagggacttggttccctgcatcctagccgctccagccatgaataaaaggggccaaggtacagcttgggccatgggttcagagagtgcaagccccaagctgtggcaactttcatgtggtattgagcctgtgggtacacagaagtcaagaattgaggtttgggaacctcttcctggatttcagaggatgtatagaaatgcctggatgtccaggcagaagttcacttcaggggtggggcactcatggagaacctctgctggggcagtgcagaagggaattgtggggtggtacccccacacagagtccccactaggtgtgatgcctagtggagctgtgagaagagccaccatcctccagaccccagaatggtagattcaccaacagctggcaccctgcatttggaaaagccacagacactcaatgctggcctgtgaaagcagccaggagggaagctgtaccctgtaaagccacaggagcagagctgctcaagaccatgggaacacacctcttgcatcagcgtaacctggatgtgagacatggagtcaaaggagatcattttggagctttaaaatttgactgtcttgctggattttggagttacatggggcctgtagcccctttgttttggccaatttatccaatttggaacaactatatttaccgaatgcctgtacccccattgtatctaggaagtaactaacttacttttgattttacagtctcatagacagaagggactctccttgtctcggatgagactgtggacttttcagttaatgctgaaatgagttatgacttgggggaatgttgggaagacatgattggttttggaatgtgaagacatttgatttggtaggggccaggggcagaatgttatggtttggctgtgtccccacccaagtctcatcttgaattgtagcccccgtaattcccatgtgttgtggaaaggacctggtgggagatagtggaatcatggggacaggtcctttccatgctatttgagatagtgaataagtctcacgagatctgatggtttgaaaaaggggagtttctctgcacaagctctcttcttttgtctgttgccatgtgagacatacctttcaccttctgccgtgattgtgtggcctccccagccatgtggaactgtgagtccattaaacctctttcttttgtaaattgctcccagtcttgagtatgtctttatcagtagcgtggaaacggactaatacatgttctttgtccattttaaaaatcaggttacttgttttcttgctattgagttgtttgagttccttttatattttttgatattaacccctcatccaggtatatgatttgaaaatattttctgcaatttcctaagcgtatcttcactgtgtggattgcttctttggctctgcagaagcttcttaattggaaacaatcccatttgtctatattttttttgtctatttttaagctttaattatctgtgcttttgggaccatgttcaaaatatttttgccaagagtaatgtcaagaaggcttcctatgtttttctctaagaattttcagggattacctttaagtcgttaatccattttgaggttatttttgaatatggtataagataaaatttcattttcattcttatgcatgtaaatatccagtgttcctaacagtagtcattgaagaggctatcctttccttattgtgtgttcttgccacctttgttgaagatcaatagactctatggttatggatttatttccagtctttctattttatttcatcaatcatatgtctgcttttgtgctggtatcatggtgttctgattactatggctttgtagtttattttgagataagatagtgtgatgcctccagcttcgttctttttgctcattattgctatggctatatgagctattttgtggttccataattttagggttgtgttttctgtttctgctaaaatgccattggcattttgatagggattgcattataccagtagatcactttgcgtaatatggacatcctgagaaaatgaattcttttagtccatgaatacaggatattgttccatttatttgtgtcctgttcaacttttttcatcaatgttttataattttcagtatataggtcattcacttctttgattaaatttattcctaagtattttatttttcatagctattataaatgagattatttcttgattttgtttttagatagttcactgttagtgtatagaaatgctgctgatttttgtatgttcattttgtatcctggaacattcatgaatttgtttgttatttctaatgggtttttggtggagtctttgcagttttctgtaagaacttgtcatctgcaaacagggacaattttacttatttctttaaaatttggatagcttttatttctttctcttttctaatttttgtggctaggacttccagtattatgttgaatagaagtggtgagtgtcggaaaccttgtcttatttattgttctagaagaaatgcttttgacttttcactaatgagtatgatgttagccatgggtttttatctaacttctttattatgttgaagtacattcaatacttaatttgttgagcattttttcaatcatggaagaatgttgtattctgtcaaatagttgttctacatctactgatattacgtgatttttatttttcattctcttaatgtagtatataacagttgttgatctacatatgttggaccattcttgcatccctaggataaatcttacttgatcttgatgaatgattttttttcattaaaggattattgaaatgattgagtttgtttcataatattttgttgatttttttcatctatgtttattagagatattgactggtaatttcttttatcttagtgttcttttctggctttagggttagggtaatgctggccatataaaaatgagtttggaaacatttcctattttaatgtttttggaaaagtttcagaagcattaatatttattcttctttaaacatttggcagaattcagcagggaagccatcaggatctgagcttttctttgatggtagacttttcaatatttatttaatcttctaaattgtttgattctgtttatattttctatttcttcatgattcagttttggtagattgtatgtttctagaaacttactcatttcttataagtgattctatttgttgatataaaattgtgcatagtagtctcataatcttctatgatattagttgtaacacttctttaattttctttatatgaatcttttttgtgttttcttagtttagttaatggtttgtcaattttgtttatcttttcaaaggaaaaaactcttagtttcattgatcttttttatttttttctagttcctatttcatttatttatttatttattttgctgtgatttttattatttctgcctcccttctgctcactttggactcaactttcttttccttctcattctccttctccttctccttccttcctttccttccttccttccttccttccttccttccttctttccttcctttcttcctccttcttccttctttctttttttctttctttctctttcttcttctttgtttcttgagatctaaagttaggctgtttatttgagaacgttcttcttttttgaagtaaccattaattgcataaattttcctattagtattgttttgttcaacccataacttttggtaggttgtgattccatgtttatttttgtcaagacatatttaagtttctcatttgaattattctttttgtttaggaacagatagtttaatttccacatctttgtgaattttcaatttttcctcctgttactgatttctaatttactaccattgtggttggcaaagatgcttgatatgatttcagtcttcttgaatttttaagacttgttttgtggtctagcatattatctatcctgaagaaagttccttgtgtgtttgagaagaatgtgtatgctgttgttgttgaatggaatgttttttatatgtcttttaggttcattgatataaagtgtaggtcaaatccaatgttgttttttttttaatagacattttatctggatgatctgttcaatgttgaaagcaagggtattcaagtcccttactattattttattgtagtctatctgtcttttcagatctattaatattttctttatatatataggtactctgattttggtgcatatatatttataattgttatatccatttaatgatttgatcttgtttttattacctaatgaccttctttttgtctactgatacattagattaaggtctgttttgtctgatatagccacccctgatctcatttggttattctttgcatggaatatcattttccatcccttcactttctatgtatgcctttaatattaaagtttgtctcttatagggagtctattgtttgatcactaaaaaaagtccagttagctaatctgtgtctttttatttgaaaatttaatccatgtaagtttaaagtaattactgataaatatttaatcttgctattttgttaattgtttggtgattgttttgtagttcttttgtttctttcctccaaccttgctttttactttgtgttttgttgtatttttatagtggtatgctctcattcttttttctttatcttttgtgcatgtactagaggtttttatttcatgattaccattaagcataaaatataatattctgatttaagctaataataacttgaatttaatcacctacaaaaactatgctttttcacctttccattacattttatgtaattgatgtcaacttattttttatattgtttttagaaaatgtattatgactatagatacttcattacttttttcttttaaattttatactacagctaaaagtgatttatataccactgttactgtattactgtattctgaatttgactatagatttacatttactagtgagttttatattttcatatttttaatgttgttacttatcatactttcatttcaaattgaagaatttcctttagtatttattgtaaatcaggtcaagtggtggtggactctcttagctttttgtgtgtcttgaaatgtgtttctctctatttcacttctgaaggacacctttgctgatgtaaaagtcttggtggtgtttttttcctgtaagcaatttgaatacatcatccttcttcctcctgttttataaggttgttgttttttttaaagggggtagggatttccattaatagcctaatggagattccttgatatgtgatgattctgttatctcttactgctgaagattctctgcctttgactttatttatttatttatttttgagacaggatcttgctttgttgcccaggctagagtgcagtggtgtgatcatagctcattgtaacttcaaattctaggtcaagcaatcctcctgccttggcctccccaagtagctaggactacagatgcatgctaccacatccagttaatttttttagtttttgaagatatggggtctggtagctaggactacggatgcatgctaccacatccagttaatttttttagtttttgaagatatggggtctcgctatgttgcccagactgatcttgaactcctggtctcaagtgatccttctgcctcagcctttcaaagtgctgtgattataggcatgaaccacccagtcctgtttttgacttttgacaattttattatattttgtcacagagtattttttggattcatcttacttgagatttttttaagtttggaaatctggatgtctgtaaccttcccaatatttgggaagttttcagccagtatttctataagtaaactttttctccctttgtcacatcttctggtgatcccataattcatatgtttttatgtttgatggtgtcacatagattccttatgctttcttcattttaaaaagaatcattttttgtttttctaactggttaatttcaaatgatctatctctgagtttgctaatttttttcttgtgtatgattgagtctgctgtttaaactctctattgtgattttcatttctgtcatattttgtagctcttggatttctattttgttctttttattgtttacattttcttattaagcttctcattttgttcatgcattatttttataattttatttaattgttggtatggtttggctgtgtccctacccaaatctcatcttaaattgtagctcccataatttctcatgttgtgggagggacccagtgggagataactgaatcacgacggcagtttttcccatactgttcttgtggtagtgaataagtctcacgaggtctgatggtaccccattcacttggctctccttctgtcttgctgacaccttgtaaaaagtgccattcaccttccaccatgataatgaggcctcccccgccatgtggaactgtaagtccattaaacctattcttcttcgcagtcttgggtatgtctttatcagcagtgtgaaaatggactaatacggttgtctatctatgtttccttgcatctcataaagcatctttagcatcattattttgaattctttttcaggcaatttgtatttctccacttttgggcgttagttactggagcttttgtggtatcatatttttctgactttttcttaactatatagccttgcaccagtatctgtgcagctgaggagcaaacacctcttccagtccttacaaaatttgacagtctgtatatgtctttataagtccttctcctgttgggtccttgggctgatggaattgcctctgaaattatggttgaatggaattggagttggctcatgtggctgatgctgtttctgtggtagggtctgaagatgatgacactgctactggggctctagcaagtatgaattctctccatttcctaggtggactgcactctctccaggaccttggttggtagggcttacactgagatgagggttcagagttaacagacatttggtctgtggccacatatatggactactgtggcttcttctgcattcttgtaagggctgccactggatttctgggtgggtcctttagcagacagacagcacttccctggtctgtatccgagatggactgggactgagtcacagagctgcttcagggtctacacctgaggccaaggtcttcatatctgtctctgggatatcatacgtgtgtgtttactagcacgttctttggtgggtacacctgctctcagattgtagttgacaggggatacaactgatttatagggctgtttcaagatccacagtgggactaatgtcagcaggttagcctgtaggggcagtaacagacacgcccatctgtaggtccctgggaaggcagaactgatttcaggctgcagtcaagatgagccaggcccaagatccagggccatttcaggttctactgtggaactaaagttgataagcctgtcctggggactcagatgggcttgtttcccagtggtgccctgactaggcagaactgttttacaactgtaaataagagatactgggaccaagatccaaggctgtaccaggatgtgctgttggactgagtctgacaagcttctcacagtggcagaggagttagtctcccagcagttccctgtgtgtgtgtgattgtttctaggccacagcagagaggggctggagctgagattggggacctgttcaggatctgctttgggataagaccaacaagcctgtcacagtggcacagatcagcaagtctcccagtgtttttgaagcatagaattttaaattatagggtatttgaacttttgtctttgttagaattcttactatatttgaaatctaatctataacatatctattaaatttctttaagtataattatgctgtaaggatacaaagaaaattaaatttacatgatatcctaacctctaggggttgttacaagtatatgacagttgatgatgatgcaagcaaggaaataatgatatagcaagggatgggcataggaacataaactgattttgaagcaggtactaccattggctactctttggttttatgtttctaaagtgtttttttttataaacaacttctttcaataactttttttgcatctttttttatccttattgtttggttttgcttataagttgatactgcaactttatattctagggggcagaaatatgttggcctcattatgttcctttagtgtatatctagaatataaaatcatcatcatatataaaattttaaacaaaggccactgtataatgccttcataggtgctggttcagcataaaaggatagccacaaatgctgacaacaacagaataatttcagcactgtcatgaagtataaattttaaacaattgaatttaaaatgcatttgtgctattttactctgaaatacagtgccacaagggaattctctcacaatgagctcacaaaaagttagcgtcttagaaattattgaatttactgtacaatggtaattcttttaagaaatgtggcaagcataactagtatccagttttgccataacagataaatgaaaggtttatccatattttaagatattaatatacatcgttttagtgtaactctgaatatgacagtattaatatgaaactttgcagattaatattaaaagacatcatgatatattcattatttttgaagttacatattactaatatatcacggtgtgtctttactacttgatgacagtttcctttattccctgcagctctctgccttgtgtttcactctgtaattctcacatcttatgttcccacagctaattctacaaacttaatgaaaaaactgtgtaggtttatttaaatattctttatgaagtaaactttatacctttttttcttttgagacggagtcttgctctgtggcccaggctggaatgcagtggcgtgatctcagctcattgcaagctccacctcccgggttcacacccttctctcgcctcagcctccctagtagctgggactacgggtgcccaccaccatgcccagctaattttgtttttgtatttttagtagagacggggtttcaccctggtagccaggatggtctcgatctgctgactttgtgatccgcccgcctcagcctcccaaagtgctgggattacagtcgtgagccgccgcgcctggccaactttatatatacctttatgtaaaaatgtcttctagtagaaaaacaggttcttagaaacctttctagtaccaaaagtaattttatgtatgcatatggagatgtgtgtatttattttaatcatctgttttttcaaaggtaataatcataagcaattagcaagaaacttagtgttctacagtatttcataatacggcaagtactgatgatttttcaaacatctctgttaaaatataattcatacatttaaaaaattacaatttgaaagtatacaattcagttgtttttactgtattcaccgggtcatgcaaacataattataatctacctttaaaatgttttcatcacccccctctaaaaagccctcagtcattagcagccattccccttcctcccttgtcccccagccctgcctctggtagccctgggcaatcaataatctacttcctatttctataggttttattcttctggaaatttcatataagtgaaattatcaaatatgtgatctttcatgactgacttttttcatgtagtgtaataaaggttcatccatgttgtattatgtaccaggactgtactaatttttattgccagacaaaattcaattataatatccaattcaaatatggctatatcatattttgtttcttcgttagttgatggacttttgacctatttccattctttggctattatgaataatgctgctatgaacattccgtgtatgttttattgtggacatttaaaaaaatcctctttggtatatatttctagaagtagatttgctgggttatatgtaaattttatgtttaatattttcatggactaccaaattgtttccaagaatagctgcatcattatacatcttgaccagcagttcatgtgtgtttctatttctccatattccacaaactcttatcattatctgtcttttttgttatagccctcccagtatgtgtgaagtgatctcattggagttttgatttgcatttccctaaggagtaatgattttaaatatctttttctgtgcttatcagtcatttgtaaatctctttggaataatcttctttggaatattcagatatttttctggactttttttagttgggtatttatctttgttttttgtttatttttattattactattttttgagacagagtctcactctgtcgcccaggctggagtgcagtggcacaatctcgactcactgcaacttctgcctcccaggttcaagcaattctcctgcctcagcctcctgggtagctgggactacaggcacatgccaccatacctggcaatttttttttttttttttagtagacatggggtttcttcaccatgttggccaggctggtctcaaactcctgacctcaggtgatccgcccgtctcggccttccaaagtgctgggattacaggtgcaagtcaccgtgccaggccatgtttttattatttaatagaagagttctttatattctggatacaaataagaaatacaaattgcaaaaattttattccattctttattgtcctcttatttttttgatggtatcatttgtagcacaatatttttaaagactgatccagtccaatttatatttttgttttttgtgtgctcctagtactaaaacaattacctaactcaaggtcacaacgttttattcatacatttttctggagagctttataattttaactcttatatttaggtgtcttatgtattttgagtgatgtttagggcatggtctgatgtgtaggagtccaagtctattttttttaaacatgcatatctagttgtcctgccatcatttgttgaaatggctgttcttcccccatttacttattttggcacccttgacaagaatcaattggccataagtgtaatggtttatttttggactttcaattttcttccatttatacacaatttatatttataccagtattatgtagttttaatattgttgctttgtagtaatgtttgaaattgggatggctgagtctccaactttattcttcttttaaaaatgttttggctgtttgagactccttgtaattatatgtgtattttagaatcagcttgtcattttctacaaagaagacagctcagattctggtaaggattacatgaaatctatagagtaaatttatatatcatcttaccaatattaattcttcttatccatgaacatgggctgtctttcaatttatttataccatctttaatttttaaacattttataattttttacagtacatcttgtacttcttttattaaattatttcgtgagaattttattttaatactattttatatgaaattatttttttaatttcattttcacattgtttattgctagtgtatagaagcacaatagacttttatacattgattttatatcctgcttacacattgatttggtatccttgcttaattaatctattagttctaatagactttttgtggattatttaggctatccaagatcatgtcatatgtgagtcgtaatagcttcacttcttcctttccagtctggatacttttaattctgttctttgctttttttttttttttttaatagctacttggtttgataagaatctccagtacaagcataaaaataagtggcaagagcaggcatccatgtctcattcctgattgcagtgggagaaaagattctgttttttactgttaaacatgttagatgtgagtttttaaaaaaatgcccacactatttatcaagtacccgtatttgtgcacccttgtcaagagtcaattgtccataaatgtaatggtttgttttgggactcttaatttcattccattgatatgcattgtatatttatgccagtatcatgtgggtttaatagaaatagagaggaagttctttttatttctagttgagtatttttaatgatgaaagaacattggatttttcaaaataatttttctgtatttattcggttatttttgtttgtttttctttttttttttctctctctactggtctttttccttttagtgtggtacattgcatttactgatttttgtatgtgaaaccaactttattttcctaggataaagcccactggatcatggtgggaatctgttaatgtttgcctaaatttgctttgctaatattttgttgaagatttctgtaaagttggtagtgatgtctccctttcattcctgattaaaacatatgttttaaaaaatgataattatgaccgggtgagaaaatcttcatatctttgtgggtctgtatggtttgtgtctgtatgtaatttcagaaaagtaacatgcatgctagattaactatgtgtatagttagatatttgtatatgtgtataagacttgcagacattttcccttactgcgtttatgtttgtaagtttatatttataaaattgaatataatatcaatgaaaaatttccagttgtgctattggcataagattgatacctttccaaatcaagggtcccataagaaaattgcaaaattcagcatcgaatatatcatacttggtgctgcttccaaaaatatacaaatattcagaaatatattttaaattggatatgtgaggcacctatcacaaaatgtcatttataacaaattatgctactttacaaattaagataataaatatttgttgacaaaataaatgaagtaaagacagcatgatgtatgttcaaatactgtaaaatttagttaccttttccaaatacagactcagaaaaaatgcagttttgtttattttatgtaagttttactttctttgatgccctttaagtaattgcacttgagctgacttgatatcaactgagaagcaaggaaaatatcaaaaagtaacattatttaaaatatattattttgcgtttataaataggcacaatttaacagtacagatcttaaaattaaaattatttaattagtattatcttcatttcatatttgaaaaagtgtgagtttgtgtcattaaagcactaaaagatgcaaaacctatgcaaacaaatgaaagtaaatatattaacttttctcaattccctaccaaggaacatcatgttgtcataactatatgtattttatcttcatagaattagttataagtagtaaatgcatgttctttaaaagtgcccttagataaatgttgtcaaattctctatatccaagaaatcactaccacaatcaagataaacattttttttcaccccaaaagtttccactgtatctcctccccatcacttcctcacctgccccaaggtgcagccaaatactactttttaatttcttttggtcacaaatataagggtttttttttcttttaagaaaatattttatgctttatgggccattcggtctgtgtgcagcagctcaactctgcttctataaaatgaaagcagtcatgtatactatctaaacaaatgaatgtggctgtattccagtagaacttatttcatatacacttaaatttgaatttcatgaaattttcatgttatgcattttttcttcatttttttttcttcaaccattaaacattttaaaaatctaccctaagctcatgggtcatacaaaagtaaaagacaagctagatttggctcatgggctatagtttgatgatccttgctgcagactgtatttgttatttctaaagttttgcatacataaaattaaatagaactttcgtttctgatttctttcactcagcatttttaatttctctttttttttttgctgagtagtattttattgtctggatataccacattttgtttattccatcacacctggtttttttctagtttgtaaggagcaatattatttgttaatattgttacttacaatattagtgttaatatttatgtgtttatatttatgtgtaagtgtatgtgtgcatgtcttgcatttctcttgggtaaatactttagagtggaattgctttttgtgctatcataaatttgtaaacgtatgtgtcaccttataggaaattgtcaaactgtttttcaaagtaattgtatcattgcatatttctgtcagaaatttatgaggattttagtgtttcattttattgtcaacatttagtgtcgtcaacctttttacattttagccattatagtatgtgtttgatggtatgtcttgttgatttacaattatatttgtctgttggctaaggacattaaatatcttttcatgtgtttattagcaagttgtctatcttttctgcttgtgcgtatgaagtatctattcagatcttttgtccacttttaaaaactgggctatttttcttctttctgttaaattttaagaagtcttataatatttcacatagaagatctccctcagatatatggattgcgaatatttccctcagcctatgacttcacttttcattttattaagagtatcttcttataaaacgaagatgttttaaagtagataaattatatgtttttttctttgatattttatactttttgtatcacgtacgtgaaatctttacctaccccaaggatgcaaatattttttctctgtttttttcttccagaaattgtatagtgttaactcttacatggaaatttgtgattaattctgagtaaaatttgtgtgtaatgtgaagttgtgatactggttccttttttctcttccagatgtccagttgttctagcaccatttgttgaaatggcaattcttttctcattgaattactttagtacatttgttgaaaactaaattgatggaatatgtgtaggattgtttctgtcttctctattctggtccattgatcactctctttggcctaatgtcattaccaaactttcttaattgctatggttttaaagcacatcttgaaattatgtcttttaagtcttctgtcttcgtcttttttaaatgctttttttttcttcatgttttaagatgtatataagttttagaagtagcttgcaagtctctacaaaaatagccggctggaattgtattgaaattttataaaatttgttgtataaattttgggagaaatgatactttaccaatacgtaattttctaattcatgtgcatggcatatctatttatttagatatttaaaaatcctttcagtagatatggttgtcggtgtatagagcttgctcatattttgttaaatttgtctctaaatatttcacaacctgttgctaataaatgatattaatgtttgcggcagcgctcctttcacgggggcaccagctgcggggggtctgtcccttgcagatccttgacctggcgacggatgaataatgtatacttgacccacagatattctgctttgccaatccagttgagggtgttcaagctgcttacagactccccactgagtgctgtaaacagttgtgactgccttgatcagctagtgagactcgcatttattcagtaagactgattaacaaaggcttgagtcaacaccagtagaaggtaactgacattgtggacttctcctccagtaaaaagcacttaagcacccaaggtacatcaaaggttagtcttttttttttatttttattttattattattatactttaagttttaggatacatgtgcacaatgtgcaggttagttacatatgtatacatgtgccatgctggtgtgctgtacccattaactcgtcatttagcattaggtatatctcctaatgctatccctcccccctccccccaccccacaacagtccccagagtgtgatgttccccttcctgtgtccatgtgttctcattgttcaattcccacctatgagtgagaacatgcggtgtttggttttttgtccttgctataaatcatgctgctataaagacacatgcacacgtatgtttattgcggcactattcacaatagcaaagacttggaaccaacccaaatgtccaacaatgatagactggattaagaaaatgtggcacatatacaccatggaatactatgaagccataaaaaatgatgtcctttgtagggacatcatgtcctttgtagggacatggatgaaattggaaatcatcattctcagtaaactatcgcaaggacaaaaggttagtcttaagatcagatgagtaaacaagctagctaggtaaactactatgccgtcctttgttgctgctttaatttgtttaaaggtaaagggaccaggctgcctttagccagttctattaccgaagctatgcaaacttctcggcctttcaagatttgtgtgtctctataactatctctgatatttttcctaccagcctgattgaacccctacaaatgttaatttcaatttctagttgcatgttattactctattaatataattgttttctattgaggtacaattcaggtaacacaaaattattatgaaatccacaatccagtggcatttaggacattcacagtgttgtgcagccaacacctgtatcaatttccagccatttccatcactgcaaaagaaaacccataaccattaaacaacccagccctgggcagctacaaatctgctttcagactttatggatttacctgttataaatagctcctataaattgaatcatgtaatatgtaatcttttgtgtttggctttttttcactgcatatttttttaagattcatctatgtagcatgtattagtactttatttcttttcattgctgaattatattccattgtatggatattttatcatttataagttgatgggcctttgggttgtttccacttatggctattgtgaatctgatcactcgtatcactactgtaaatctactacttatgttatgatatatagtatcgtcatcatcacttttgaaggaaatttgtgtttattataaatttttagttttattgtgtgattaagtgttgttaccactttgtgtaaggtactgatgttttcctgtgacataatgcatgattatgttttgtgaatgttttatgtgtagtgggaagaaggcgtattctttagtatcaaggcataagcctggaatctattcagctatcttgttataatatctaacttagtgattattttctttaggccttttacagtttttcatattttatatctactgttttgtactaagagtggtgtgctggtttctactaggtgtggtgtgctaaagtctttctatttgtctccttactccttatgtcttctgtgattttgctttgtaaacatagttgctttgttatttgtcactgaaatattcataactgttatatattcatgatgacttttagctttggtactaaaaaggtctttgtcatatttaatgcttttttggtttaagttttattttaatttaattgataccaggtttgtaatctctgcattcttattgtttccatttgcctggtaaaccttctctatctcttatttttagtttttctgagtcacttggttctaaatgtggctctactttagcgcatgtagttggttgtgctttatgagacaaaatagataagttaagcctattcatcttcattgttattattgataggttattttttctcatttatgttatatatacacattatttataatgtgtatcatattatatttgttgtgcttatttctctgtgatgtgtttctctgctctttaattaaaaaataatatttacattcatggagatttgtaattttgttccattactcacctttgtttttatttatgttttgaattttatttttaattttaattgacaaataataattatatgtattatatgtttgtggggtaaaatgtggcatttacattttgatatatgttttcattttggaaggatgaaactaagctaattatttttgtgttaataacatttaaaatctactcttagtaattttgaaatatatattctgtccagtagattactaaagcttattcctcctaaccgaaattttgtactctttgatcaacctttcttctttccccttccatcgctcctaaccctggcttgtggtaatcatcattctactttcttcttctatgaatttgatattttttagatcccacatataattgagatcatgtagtagttgtctttttgtgcctggtttatttcatttagcattaattcatcttgtctttttaaaagctgaggccgggtgcggtggctcacacctataataccagcactttgggaggccgcggatggcggatcatgaggtcagaagttcgagaccagcctgcccaacatagtgaaaccccatctctactaaatatacaaaaattagccaggcgggcattagtggtggtgggtgcttgtaatcccagctactcgggaggctgaggcaggagaattgcttggacctgggaggtggaggttgcagtgagccaagattgcgccattgcacttcagcccgagactccgtctcaaaaaaaaaaaaagctgaatagtattcaaatgtgtatgtgtatatatatatatatatatatatatatatatatatatatatatatatatatttcatccaatgatggacacctaggttgcatctatattgtagctattgtgaataatgctgcagtgaacacaggagtacgactatctctttggcatacttatttcatttcctttggctatatacccagaacaggagttactggacgatatggtaattgtaattttacttttcagatgacactccaaactcttttcataatgactattattttaaattttcaccaacagtacacatggttcctttttctgctcatccctgccagcatttgttaaatttcatcattttgataatagccacttaaacacgtgtgaggtgataactcattgtcattttaatttacattttcctaatgattagtgatagtgaacagtttttcatatacctattggccatttgtatgtctgcttttaaaaaaaatttatttaggtcctttgtccattttaaaattgtgttctttcttttcttgctattgagttgcttgaatttcttatgtattttgaatattagcctcttaccagatgtatgggttgtgaatattttctcccggtatgtggattgtctctttactctattgattatttcctttattgtgcttaagatttttagtttgatgcagtctcatttgtttatttttgcttttgttttgcatgtgcttttgggaaaaccaagaaatttttgcccagatcaatgtcatgtagcatttcccttgttttcttctacagttttgggacttacctttaagtctttagtgcattttgagttgagttttgtgtattgaataaggttctaatctcattattttgcatgtgaatatctagttttccctgcataatttattcaagagactatcttttctccattgtgtgttcttgacacttttgtcaaaaatcagtagattgtcagtgcttgagtttattgctgggctctatattctgttcctttggttgatgtttctttttctttatgttggcactatgctgttttgtttaatataggtttgtagtatattttgagatcaaatagtttgatgccttcagttttattcttgctcattaatttccatatgaattttaaaattgctttttctctttcagtgaaaaatgccattggcattttgtcagaaattgcattgacttagtatattacttttggtagcatgggcattttaacaatactaattatcccaatccatgaacatgggctacctttccatttatataagtcactcgctatttctttccttaatgttttgtggttttcagtatttagagcttttaagtccttggttaaatttacttccaagtattttttatgctatcatgaatgggattgatgtcttaatttctttttcagttagttcattgttagtgtgaagggatgttattgatttttgtatgttgattttgtattcttcaactttactgaacttctgtatcagttctaacatatttttgggggaatctttagggttttctgtagacaagatcatgtcatcagcaaacagaaacaatttaactttttaattaactttttaatttcctatttggatgccctttatttcttcttcctttctgtctgtttgctgtggctagaacttttagtactacattgaacagaagtggtaaaggtggacatccttgtcttctttttgattatagaaaaaagctaaactttttacctttcagtatgatgttagctgtgggtatatcataggttgatgcagaagtaattgtggaatatatgacctttattgtgttgaggcctggagcctgacaatgcagggactagtctggtagtgggatgggtctggattctgatactgcagtggccagcatggagcttgggactgtggggtcatgcttgaccttgggttcagtgaggcagatctggtgttgcagtccaatgaaaagttgagtgcttatttcattcttccttgacttaggggtatcttgctcagtgttgtgctgcttgggcttgtgggaggggtaatatggataatattaaactggcttttctacactattcaatgcatttttttttttctttcggactgcagtaaggtggtataatctcttgtctggattccttagctgttgggaaggtattatgatgcatggatagtttttcaaatgaatgtttctatgagagatgaacactagaaagtcttattccactatcttcctaacatcactcctctagagttttttttttaatccagatatatgggggttttagtagagttttatttgtttattattcatttttgacttaattgtattgtcatcaggactcattgtatgatactatttttaggaatttgttgcagttatcttcatttgctaatggcaagttaaatattataaatgatttatatatgctggtttttaaaaacaggaattgataaacataaaatttagggtagtggttacttctggtgggaagaggcagtaagaaaggttaagggagcaacacacagatcgatacaagtagtagcattagaaatctagtccttaaattagatagtttaattatcccattatataaattactaacagttttacaagcagaaaatgtacatgctatttaaaatcaccaccataatcttttgtcttcacaaaataataagcagtactttttttcagattttttcttatatagatgtaatttatatcattcccaagcaagacatagagtataatcaaaatacagtagttttctctgtcactgaccctttaaaatatattcagtgcaatacatttttcccttgatcttgtatgaaatctcagactcactcttagttaatataaggaactcctgagaatttaatttgcaaacacgtgtgtaagtaaataattaaacttgtctagatcagataaaagtaagaactctgaacatattttgaagccaaattttctcttctcctctattccatatgttctttcattcttagcctagtattttcctcctttcctggctcaataatttttttgatctttctaggggagaggagaaaattatagtcttatgtgtgaagaatagttgtcatatttagttaaggtcctctgtgtgagagatgcacaatggctgatccattctcacataaatgtctttgggggctcttctgagtcttgacctttctagatgcaattctcgtgatctgtgggagacacatactttcttcctgttctggcaacttttacttcagttttcagttgaagtcctccagcacttccaggcaatcctgttggtcagaatattaagtagatgctggctagctggaagaaacatactttctttttcttgacttcagtgttagtacaaatatttcctaaaagtaactgtttctatttgtccttccacctcagttaaatagccatagctggtcacacctaattcagaatttcctctaatatgccacctagattttaaggggacccacagcagactcttcaaaaacttctgtgaagtcccactcattaggcttgtgtaagaggacagacaaccactcccttggcaggcagaagactggattactaacactgaaatgggcttttctgataatccccatccaatctttccccctttcactctttttgccccttttattgactctatctggttcaaagattactggttttgaacttttgttttagtctcttcttttgaaaatgttcatattggtcttatatttcacttaggtatacagtatctattttctttcagagactcaattgaactagcaatatgattatctggttacatttgtttgcatttattaattcattaacatatatgttagagttactattgatactggaagaaaaataatgaaaaagttgaacattgggaaattttgactcattcacttaattttatatggctctacaattcaggaaaagaccatatcatttcatttttgtcaatagaatggtttagctaactggtagtgtacaagaacagcagtagttctcattaggtgtttttgaaagagttagtgacaccatcagccttgtctgtttagaatgtgttattggattggagaattaattgtaacctggaaatactgaaggcaaagatatctgctatgtgattatattgttgtcagtaagagaaagtggatgacaatactttgtggtggctgttagaatgaaaaggaggggtcagatacaagaaagattatacatgtagaaattaaaatctaccaattgactggatgttggacataattaagtgtgaggtttatgtcctaaataattgaacagtgctctttaagaaaggattgcaaagtaagaaaaggagacaagtttatatgaaccaaattaatcatgcaacttttacaaaatggaaagtttcgtctagtactctaaaaggatgatctaaaaagatctaaaaggatactctaaaaggatgaggatgatctcagaaacttaaaagggtgaatttagaggaaataaatagatgttcttttttaaaacacaatctgcagctatgtttttattattcttaccagtagtaataacagtggaagtaatatctgccaattattaagtgctcaatatgtgttatgtgtcttaaattacattacctcatttaattttcacatcaatcctggaagctaagtgctgttattcttcttttgcaaatgaagaaattaagcataaacaggttaagtaaattgtccaaggtcatatagtgattttagatgtaaattttgaacccaagctgtttgagtacaaagctctggcactaacgctttgaaactcactttattaaagaaatataccaaagtgaaaatggagagaagcccaaagaagaattagataacagttatatccacagtagacttcaggatatcccccaaagactttaaggaatttcacaaaattttcagaaaagtgaatttacttccctttaattaaaaataatttatactatctggtaaccttagtttttggatggcaagaggaagttacaggacataaaaataaggtaataataatacttgaaatgtgaaatgtgcatgtttgtgatgtagaatattcaatatcattttggttttgacttacagcttgtacatgcagtggccatgcaaatatctgtcatctgcacacaggaaaatgtttctgcacaactaaaggaataaaaggtgaccaatgccaattgtaagtaagaatgactttttagaactttcgtggattgaatttgtgttgttgaagtaatttttatgttttactttttaatttagtgttgtgctagttaggcatacctttattacaatttttaacttttattttagatttgagggtacatgtgcaggtttttaacatgggtgtattgcatgatgctgaggtttgggatatgattgatcccattatccagatactgtgcatagtacccaatagataattttaaagtactttttccccttcctgcctctctctctctagcagttcccagtgtctgttgttcccatctttgtgtccctgtgtaccaatatttagctcccatttataagcaaaaacatgtggcatttggatttctgttcctatgttaatttgcttaggataatgtatccatgtggcagaggatatgatttcattttttatggctgtgtagtattccatggtgtatgtggaccacattttctttatccagtccagtgttgatgggcatttaggttgattccatgtccttgctattctgaatactgctgcagtgaacatataggtgcatgtgtctttttggtagaatgatttatttttctttgagaatttacttgcacctaatgaattctctttaaaaattaaaccttttaaagaacaattttgtagaggctttaaaacaaccccatagaacatgttatcttttgcatttctagaaaaagatgcattcttaatcttatgtatcaaatctacattatctttacacttttctttcatattatacctaatataatgtctctatgccgttcttttttcagtcatttattattaattctgataattaattccaattcttgtcctttaaccctttcagctggttccttatattcatcttcttctcttttctctgttctttcagtatgcaggaaccctctactgctactctcctctctgtactttcatgaatgatttttgtcttagcatttagtttttattctaaaattttattttccttcaaaaattaactttaaaaggcagcattttaggctatttaaattgttttttattctttttcttgtttatctatattattaaaatcaaatttttatggttttgaattatatatgtacaaatacatgtttatattaggtatatatgtactgtatttgacacaaataataaattccaaccataataattacagaaacatagggaaagtttaataaagaattcttcaaaactataaatatataaaaatttatacctaaagtctattaagcatggaaaatgatccttttatttttatttaaaataaatatattacttgttgcagagttatcctaaatgtttcaagttaggtgattatgtctttgcttagccacctaagtattacagattttcaaattcagacaaggtaagcacaatcagtttttattccttctctatagtctgaagttaaatacaagttcacagcaaaagatcttgggggaattcctattaaggaaggccattttggtcttaaaaccaacggaattaaatcattgtcttctgttctaagatcaaggatgcctctaatactttgcaacactaaagcttgattataagtaaggccaacttcatgggcacgtggcctgtgaatttatacaggttcccacacttacaagggcagcacacttggtttagtgctctgctatcatcatcttgaaattcttaataacttttaaataagaactctacattcttcttttgcacaatgttctcctattccctgcaattatgtataatagcatgttctggttataagtaatgtttctcttgattaacttctattaaatatgttggttggatagcagtgtgcagcaatgaaaatattttctgtagaccatagtggcagtattacagataaaaataatatatgagattctaccatgatagtaaacactgtcaatcttcttagtatagttttacttaaatagtatagccatataactatccataataaatagttctttgatacagtattgcagtaacatatttttgtttacagacaaaagaaagcagaattttaattcattgaaatagtgagcttgtaagcttagctaaaatagagttataagatttggcatatgtgcaaaatattagaaaatcaatcatatagttcttaatgataaaagtacattttccccgttctcatttatggctttttatgaagaggataataatggaatactaatttgtaaagagtattttgtaggtggtatttgtacacagaattccattcatttacttttttgtttatttagcttttgagtatggagcaataaagaataggctcattatttttagagcaattaattgctataatctgcttatacctgaaaaaaatggtttgttaggaaggagagctactccttcaaatcagtaaacaattattaagtgagtacttgatactactaatgaagatgaataacatatggtttttgttgaaagtatctcagactagcagtgaagacactgaccaaaatacagtataccaatttcttacattagtgatttaatatgcttatgaaccccttccacttcttaggataatttctgtttggttttaagtatttagtcagatatcatatcttatatattcttaataaccatcctaaactgaaatcggttctcttcatatctgttaatttcttttcttgcattatttgtgtacttgtctgtgtcctttactagagtgaacttttggggggaccattgcaacaataccacaatgtaagtgttcaataaatttgtttaatagaatggaatgaagaaagtattgatggagcactgaaaagggaagtattaatttattttggttggataagaaaaatttaagtagaggatgtttgaactagaacctgaaggagtaataaaatcaactttctgggaaaagaaaataggaaacaaggggaaatgcatcaataaaagcaaagaagtagaaatgaacatgatcatagcatttccggtctttgctcaagaatgttgagagctggaaaaatattgcttctacccttacaatgaaaggggaaaaagctggataaactgtaaattcatgagttttcttgaaaccattggagaactgagaaaacagggtaatcaaatgaccacaaatctaaagagagacaagagactgcagagagatgagacatgaacattggcttacctggagcaaaatcatctggaaactgataagaagagatcagctagggtagttgatatttggcggggattaggtatacactgtcaatagtgtgaagctcctgggagccacagaaattggtagagtatggagagcatactctttgtagagttttcaagccacctactgtggctgccattcccttccaccagttgctcaggtaaaaaaaatgaacattttaagagagcattccttgtattgtaccttgtggaagggattggcagccgcagtgggcagggcatcagtagtacagtcaaaatattcatttagatgagcaccaaatgattcattttgctgtagtaatgacagttttcagtctttttttggcccaaaacacagctgatcgtcaaaaattgtaacttaaaaatgaatttccatttgtgtcatctctgatttttttgtgcagtggtttttagttttccttgtagagatctttctcttgcctgggtgttttcctaggcacacataattgtgtggcagttatgaatggaagttctttcctgatttggctctcagcttgactgttattagtgtataggaatgctattgatttttgcacattgtatcctgatactttgctgaagttgtttatcagctgaagaagcttttgggccgagactatggggttttctagatgtaggatcatgttgtctgcaagcagggatagtttgacttcccttctttttatttagatgcctttgtttatttcttttgcctgactgccctggtgagaacttcagatactatgttgaatggaagtggtgagagagggcgtccttgtcttgtgctggttttcaaggggaatgcttccagcttttgtgcattcagtatgatgttggctgtgggtttgttatagatggctcttaatattttgaagtatgttccttcagtacctaatttgctgagagtttttaacatgagtggatgttgaattttatagaaacccctttctgcatctattgagataatcatgtgctttttgtgtttagttctgtttatattatgaatcacatttgctgatttgcttatgttgaaccaaccttgcatcccagggataaagcctacttgatcatggtggataagctttttgatatgctgctgaattgtttgccagtgttttgttgaggatttttgcatcaatgttcatccaggatatccacctgtaattttctttttttgttgtgtctctgccaggttttagtatcaagatgaggctggcctcatagattgagttagggaggagtcccttttcctcaattttttattgaggagagtatatctggtagaattcatctgtgaactcatcatgtcctgggtttctttggttggtaggctattactgcctcaatttcagagctgattattggtctgttcaggaattctgtttcatcctggttcagtcttgggagggtttatgcgtccagaaatttatcctttttttattttctagtttatgtgcatggaggttttcataatgttctctcatggttgttcatatttctgtggggtcagtggtaatacccttcttgttgtttctgattgcgtttatttgaatcttctctttttcctttgttagtctagctagtggtctagcaattttattattttcttcaaaaaccagctcctggatgcattgatctttttatcttttgtgtgtgtgtgtgtctttatctccttcatttcatctatgattttgtttatttcttgtcttctgctagctctgggatttgtttgctcttggttctgtagttcttttagttatggtgttaggttgttaacttgagagctttctaactttttgatgtggacatttagtgctataaatttctctcttaagacttcctggaagacaacctaggcaatgccgtttaggacataggcatggacaaatatttcatgatgaaggcaccgaaagcaattgtaacaaaagcaaaaattggcaaatgggatctaattaaagagcttctgcacagcaaaataaagcattaacagagtaaacagcctacagaattggagaagatttttgcaaactatacatctgacaaaagtctaatttctatcatctataaggaatttaaacaaatttacaagaaaaaaccaaccccataaaaagtgggcaaaggacacgaacagacacttttcaaaagaagacatatatgtggccaaaactcatatgaaaaaagttctacatcactgatcattagagagaattaaaactggacctcttccttacactgttaatgcaaaaattaactcaagttggattaaagacttaaatgtaaaactatataatttgattgtgctgtggtccaagagactgtaatgatttcagttcttttgcatttcttgaaaagtgttttaattctaattatgtgattgattttagagtatatgccatgcagtgatgagatgaatgtatattgtgttctttttgagtggagagttctgcctgtatctatgagatccatttgatccagtgctgaattcaggtcctgaatatctttgttaattttctgtctcagtgatctgtctaatattgtcagtggtgtgttaatgtctcccactatgattgtataggagcttaagtctctttgaagatctctgagaacttgctttatgaatctggattctcctgtataggtgcatatatatttaagatagttagattttcttactgaattgaaccctttaccattatgtaatgctgttctttgcctttttgatttttgtgaatttaaagtctgttttgtcagaaactaggattacaactcctgcttttttctctttttcatttggtaggtagatttttctccattccttagttttgaggctatgtgtgtcattgcatgtgaaatgggtttcttgaagacagcataccaacgggtcttggatctttattcggtttgcctttctatgtcttttaattgggggcatttaacccatttacatttaaggttaccataaaatatttaatttccaacagaatttaacaaagacattgttatgtcttatatgcagtaagtgtactaactaaatgtattttggttggaaaaagataaacattgatttattaggttaatggttcttggtggagatggaatagcaccccctagaacttcataggttttcataattaattattctaataattggggagtgctactggcataagaggatgaatagtcacagcctcttattagaatgggcacttacagagaccaggaaataaataaaatctaagtccaaatatgtttcattgagtacagtagatctacaaactcactctgtagtcattttccctgttccttagttcataattaaaatggatgtatgtagcagccagcagatgtctcatattggcttcctgacctgtggagaaagagccagtaaggtagagaagggccaagagaaagaaacccttgaaactaattccattcattctggacccagtcaagatggcaaatcagagatctcatgtcaagacaaatagcaggctgctgaaatggagaaaatgagggattatgatattctcaaatatgagctggatcctatttataagtgtagtgccaaaataattccctagcttaaaatgtggacagaattgtgataaaatctaacagaaaatatattttctttcttgaaatcctaccacatgtcaatgtatacattctgtttctggtatgtaaaaagactgtagagactatatcatgtcttaggaaacgggacatatttgaaaaggaaatagtaatataagagccagtcaagtcatgttgtagacctctggaacattatcagagtcccctgtttaaaaacaattgcaatctcccccacagtaattttaccatgtagtttctaccgcatacattttatattatagcactatgaaattttaacaaatgcataggacaggaataatatgataattttagttcctatattatgaaattcagtagtactcataatttggcaccaatttaatatgtttttgtttttatctcttaagaggtatctcaaatattctccagacacattgtatactcacagatgtgtgtgagcaggatagctattggtgatgagattttcttaaatgaatatctcttggtcaaattctgaataatattataaaaggtatattttcaatttacatgatagttgcagttgtagaaaattcaatatgtgttataaatatgcaaaactactttgtgtttatatgtaaaatggagttagattccaggctgaaatatttatgagcacatttttcacctacttaaacatctgccatgttattctaaaattatatgagattttgatcccttttttattttgtggaattactttgtatttttgtaggatgtctgcacccctggtttctctttcattccattcagtaaattccagtggaactccataattatggaaataatgaattgttactcacaaatttatccccactcacaaccatgtgccttaaaaattagtgttttcccttatctagccaaaaaaagtttattgtttcactgtttaatataagagctcagatcattttattgatttctggtgaaaagtacatataaatggcactcttagatattttgttggtagattagtcaaaattgatgagttgattcaaaattgttttactctctgttcacagtaaattgaagataaacttctcaaaggcatttggaattaaaaataccatttcctaagatatatggcaatattactaatcaggatcttaattgtgctaattaacttataactggctccccttttctgttccttatacctttcccatttactgatcttacaacttcttcatagctacttacttcaggcttaagaccctggttctcagaattagggcacagaagaatctcctgggatatggtgactaaactcctgggatgggagccaaaattctactttactaatagtaaattgtgaaataaaaattcttgatacattttgagaaatgttgccgtaggaggatcttcctgaacattttttttcctccttggcttacctttaggccagtaatatctaagattattacccatttttctctatcttgttttatcaagtctcttttgtttgtttgttttgtgaaattgccttaatgatgatgccaatgaattcctttccgttttaggaagatcaaagttgtgccttcttttctagaacagattctggcacatactagggactttagatttttaaaaataatgtatcttggatctttatttttcctaattactctcatctttttttttttttttttttagtctgctatatggggaaaagtacatcttttctctatgtgacttaatctacattgttataatagagactacagaggaagaataattttctgtacagcctgcctgcacataggttatcacctttataaacacaattggataagtaactagtgactatggtcttcaaatactgacactaactttttttttgtttgttttgagacaaagtctagctctgtcccccagactggagtgcaatggcacaatcttggctcactgcaacctccactctctgggttcaagcgattctcatgcctcagcctcctgagtagctggactacaggcactcgccaccgcacccggctaatttttgtatttttatgagagatggggtttcatgttggccaagctggtctcaaactcctgacctcaagtgatccgtccaccttggcctaccaaagtcctgggattacaggcatgagccagtgcacccagcctccaacactaaatattgttaagatttttctaggttgttttgttgctgtatttgcaactgcagataagactaatggtttctttgtgataatgagttaagcagccttgatgtctaatatataagatacttgaggaactcttatgcttgctttattctgtaaacatttattcactgagaggctatgagacagtaccaaaagcatacatctgaaaatatcagttcagaacgcatgttactcatgttaaggttggccagtatgaaaccatatatggttttgtccgatttctacccttgaggaatatgttttggtaacaagtctaacttgagcatataacttcctatgtcaggtaaatgtttgagttcttttggagtatgacttaatgaatttaaagctcttggattttaggaatgtactttcaaagttaaatgttagttctcccatcagtctttctataccaacaccttgtccctcaaaactatactagattgaatgtcatttaatcgccaattttgaaaacattctgaacacaactcagctgtatttcgcagcctccattgcagttaggttggaagtcatgttattgggctctgtccggtagacagaagtaacacccaccacttctaggcctggctcttaaaaacctcatgtgccatacaccctctgtttcctcattcagcagttcaatggagaggaagatgaggatctgaaagattgcagaggctaggaatagcccagatcctggaagactgcatggaccaagaccttttctccaaatccattccacactggacagtgtcttcaagctggaatcaaacttattgtatagaactgctgagattttaaggttgcttgctagagttagcatattcttccatgagtaattagtattcccttagcatctagcttgacatccttaattactgtactttcatttaaataaccttaagggtcctgttcattaagtgtgactgctggagtaggttagtgaacagtgtggtggtatttaggtttaatttgttctttaatccccattcatctcttaaaacttgcaaaaacctcccagctttttttttttttttttaaatcaaagctgttctcatttaaagctattgtttgggagactagtatagtccatgatttccaacttgattattacattcacataaggcataaaagttaaatggctttatttaactctagatggtcagaatggttcccaatacatgatagaattgttggaattgctaataaaaaagaaaagtgcacagtaaagaacagagtatcaagttaagatttaggatatactacctacaagttggaagaaattagaaaaagaaacaaatgtgtatgtcaaagaaagagacagcactttaagcatttattttactttgatcagtcttctatatatttattattaagttatcttgaaatatcaggggatgaaataaatagcctagtatgtcccaacttaacattgtatgaagaaataaagttttaacatttaaatgtagaaaatatatctggtatatgtgtaggtgttttatcaaaatatggactctcatgtcaaatgcatgtgtgttataggatgaactactgctatacactagtatgtccttttgatttatttctggagctccagtgtagtggctatgttgtatagtttagcacttctggttttatggaaaaatggtaagtgactgaacatatttcagtgtaatctctttttataacaattttcttttttgtcttgttttggcaatttgccggtgcaaatatgatatcctttctttattgttaataatgtttgtcctctcacctcaacataatgttttgagatttatccaagttgctgcattcagatagctgtaatgtgatcctattcaatgttgtagagtatttcattatataattataacacacttcattcatttgcctgttttctttttttttttaattatactttaagttttagggtatacgtgcacaacgtgcaggttagttacatatgtatacatgtgccatattggtgtgctgcacccagtaactcgtcatttaacattaggtatatctccaaatgctatccctcccccctccccccaccccacaacaggccccagtttgtgatgtcccccttcctgtgtccatgtattctcattgttcagttcccacctatgagtgagaacatgcggtgtttgtttttttgtccttgcaatagtttgctgagaatgatggtttctagcttcatccatgtccctacaaaggacataaactcatcattttttacggctgcatagtattccatggtgtatatgtgccacattttcttaatccagtctatcattgttggacatttgggttagttccaagtctttgctattgtgagtagtgccgcaataaacatacatgtgcatgtgtctttatagcagcatgatttataatcctttgggtatatacccagtaatgggatggctgggtcaaatggtatttctagttctagatccctgaggaatcgccacactgacttccacaatggttgttttctttttttgataattccagttttgtttttcctttttcaccattactgttaatgttttatcagtattcttatatgtttcctggcttacaaatgcatacattttgttgagtgtgtattcattattcatattttcaactttggaaaattaactgttttgtaaagtgattatattaaattatacccattccaagtctttatgaattttattaatgctccacatctttgctgatagttggtattccaaggcattttaattttgacacttctgatagatgtgtaattgctatgttcttaagcttaaaaaattccttagttcttaaaagtttattatgtttaatctttaaaagtttcatctctttaatcaccggtggaattttctctttttatgatgtagtattatctcaagtttcttgtgatttttctgctggattctccttaatcatttttagtaatattttatacatgctatgtacacgtcttttgttggtgatatgtttagtaaatgtcactctgtggttggactttcatgccaatttgtatgtctataatgagacattcttaattttaatataatccagtatatccatcttttccctatggttagtgcttttttgggttctgtttaaaaattctttctgttctccattatcaagtagtattcagatagccagttggtcatggaatttatttttggcctgaaggttttaactttcatccaatttctttaaaagagataaactattcagatttttgtttcttctagtgtctgttttgttcttttcctttaaaatattttcatttatttatttaaattggattttatttttaaattgacacgataatggtacatatttatggtgttcataatgatgtttcagtacatgcagtgcataatgatcagatagggcaatcagcatttataatctgtttgtgttaggaacattaacacaaattatctttccagcgatttgagctatataatgtattattgttaactatagtcctcttaaagtagtatagaacattagaacttattcctcctatctagttgtaatgtaatatgctttaacaaatctctccttatttctctttccctacacccttcccagccactagtaccttctgttctactttttacttctatgagatcaactttttttttttagcttccacatgtctaaagacatgcagtgtttaactttctattcctggcttatttcacttcatgtaatgtcttccagttccatccatgttgccacgaacgacaggatttccttctttttaatggctgaataatattccattgtgtatatatcctacatttcctttattcatctattgatgtacacttaggttgattacatatctttgctattgcaaatagcattgcaataaatatgacgatgcaagtatgcctttgacatactaatttattttcctttgtataaatacccagtagtgggaagtctgcatcatatgtatggtagttctatttttagtattttgagaaatttccatactgttttccatactggctgtactagtttacattcttatcaacaatgtataagagttcctttttaccacatccccaccggcatcttatatttttgtcttaaaaagacacagccattttaacacagccattttaactggggtcagatgatatctctttgtggttttgatttgcatttctttttttttttttttttttttttttttttgagacggagtctcgctctgtcgcccaggccggactgcggactgcagtggcgcaatctcggctcactgcaagctccgcttcccgggttcacgccattctcctgcctcagcctcccgagtagccgggactacaggcgcccgccaccgcgcccggctaattttttgtatttttagtagagacggggtttcaccttgttagccaggatggtctcgatctcctgacctcatgatccacccgcctcggcctcccaaagtgctgggattacaggcgtgagccaccgcgcccggcctgatttgcatttcttgatgattagtgatgttggccattttttcataggtttgctggtgattttgtatgtcttgttttgagaaatgtctgttcagattatttgcccattttacaattagatcgtttgttttcttgctgttgcaatgtttgagttccttatgtattctggctcttaatatcctgtcagatgaatagtttgcaacccattctgtggattgtctttttactctgttgattgtttcctttgctgtgcagaagttttttatcttgatatagttatatttgttaatttttgcctttgttgcctgtgcttttgaagtcttattcataaaatcttttcccagatccatgtcctgaagcattcccctggcgtttttttctagtagttttattgtttctggccttacatttaggtatttgatccatttttccgttgttttttgtatagggcaagaggtgaggggtctagtttaattctaatgcatatggatatccagttttcccagaaccgtttattgaagaggttattttttctccaagtcatctttgttcttggcatctttgtcaaaaatcagttggctgtagatatgtaatttctgtgttctccattatgtttcattgatctatgtgtctgtttttatgccagtacctgtcattttggttagtactactttgtggtatattttgaagtctggtagtgtgatacctccagctttgttcttttttgctcaggattgctctgactactaaaggtcttctgaggttctatacaaattttattttattacttttttctatttctgtgaacaatgtcattggtagtttgaaaggaattgcattcaatctgtatagctttgtgtaatatggccattttaacaatattaattgtgattcgtgggcatgagatgtctttttatttgtttgcattctcctcaattttatcagtttattttgtagttttccttgtagagttctttcacctccttggttatatttatttctaggtacttttttgttagttattctagatgagatttgcctcttgatttctttttcagctactttgttgtttgtatattgaaatgctactgattttttaatgttgattttgtaacctacaagtttagtgaattcattcagcagttctattaaataatagtgttttgggagattctttaggattttctgtacacaagatcatgtgatctgcaaacaggacaatttcacttcctcttttccaatttggatgccttttatgtctttttcttgcccaattgctctggctgggactttcaacactatgttggataagcatggtgagagtggtaatttttgtcttgttttagttcttactgaaaaacaaacaaacaaaaaaacaaaaaccaagagcatgatagtaaaacaggagtagattaaccctgataccaaaaccagacaaggatacaacaacaaaaagaaaactataggctaatatccctgatgaacatgtatgcaaaaatcctgaacaaaacaaaagtgttcagcttttccctattcaaattagtgtttggtgtggtttgtcatgtatggcctgtattgtgttgaggtactttccttctatacctaatttatggggagttttttttatcatggagagatgttgaattttgtcaaatgctctttctgcatcttttgagattatcatatggcttttttccttcattttgttgatgtgatgtgtcacatttattgatttgcattgtgttgaaccatccttacattccagggataaaccccacttgatcttagtgtattatctttttatatattgttggatttgatttgcagtattctgttcaggagttttgaaaatgtccatcagtgatattagcctatagttttctttttgttgttgtgtccttatctggttttggtatcagggttaacctagtcctgttttactatgatgctcttgtttactgctattttttcatttatcagtttggagatttcagaaagtttagccatttctctttaaaaattgctacttttttttttttttaacagagtcttgctctgtcactagactggagtgcagtggcacaatcttggctcactggaaactctgcctctcgggttcaagtgattctcctgcctcagcctcccgagtagctgggactacaggtgtgcaccacacacccagctaatttttgtatttttagtagagatgcagtttcaccatgttggccaggatggtctcgatctcttgacctcatgatctgcccgccttggccttccaaagtgctgggattacaggcatgagccaccgcacctggcctctctctctctgttttaaaaatattatatgatagcattttggtgggtttctttagggaaaaaaagagaaaaataagtgtgttttaccttttatatctttatatcttcatttaaaaagaaatattttattttcagagacagagtctcactcaacttgtcatccaggctggggttcagtgatgcgatcttggctcactgcaacctctgcctcgtgggttcaagtgattcttctgtctcagcctcctgagtagctgggattacaggtgtgcgccaccatgccctgctaatttttgtatgtttagtagagacagggttttaccatgttggccaggctggtctcaaactcctgacctcgtgatccacccacctcggcatcccaaagtactgggactacaggcatgagtcatcatgcttggcctaccccttcatatttaatcataaaaatgcaaaattatttagcagattttcagctgttttaaataatctgtaatattttaaaattatggctgttacatgccccttattttagtctctgagtaaaaaaattatgtatcttgacaaggtatatgtatatatttaaacatttgaatatatatttaatatatttaatatctaagtgttcgtattataaattcaaatatttaaataaattaaatatttaaatttaaaattttaatttaaacatttaaattaaaaatactttaaaacttataaatgtagaattattttatattttgttttatacaaaatgtgtataacaatgttagcgtttacataaatgataatcattatttaggtgacatttaatgagattatttacttcttcaaagtctgtaatacatagttcagcctaaatctgttttccatgaaagtccagctgcttgattagtttgcttagtggaaaaggagtatgattatctctttgcttagacacagaaaccctttgaaattacatttttaattaagccattacagaagacttctaaaggcttttaatgtttttatcagtcttgaagggttctgagtttttaaaatattatttagctcaaatatcagaaatattaacatgatttatgttgtaaagtatcaatttgtttaaggaattattatttatatttaaatgttttacattttatttacctgttgtaatctgaagttgaacttgctaaaataatttatgtctcaatttgcttttttattatgtgaattagattagtggttcatgttcatacctcaagtaaatatattgaaatattttatattataaaattctatctataacaaaaattttatgttgggcagctcctatattgaccattaattatctatgacttctggtattcataccattgtgtagttccatttccttccttgagtgtgggcaggacctgtgcttgcttctaaaccagaaaataatgcaaagttaatgggatattactcctattattttgttacattacatggtaaaagtgatggttttcacttctgtgaatatgctgtgaagtctatgcttcctagaaaacttgctctagtgattttttcttttgctggctctgagaaaaatgtagctgagagtatcctctagcagctgaggatagccaccagccaatagcaagtgaaaaaccaaggccctcggtcctatagtggtaaggaaataaattttgccaaaaacctgagggaaaatagaagcaggcatatgcctagttagtcctctgattaaaaccagtcccagctgacacctgattgcaggattacagtggaccctaggtgcagccaacgtcttgattgcagtctgctgtgactctgaatcagagaacctggttatgccatgctcagactcctgatccacggaaacagtgatataataaatgtgtgttgattatagttaccaaatttatgtatttttattgagcaatagataactagtacaaatattatatccaagtactctgatattttatttactgaattatacaactctacattagatatttttgtaatatattccttaagtgttttcagactaggaaggagatttctagtctttggtagatattttcttgaatggggaaaataatttcaacaatgcagattaagacttttcctagaacagagcatttctgaagaaattttacctttgtgtaaataaacacagtagactgttacagaataaatgagttaaactattttaattgatctgagtaatttacattttatatctgcaaaattgccttaataaggtatttgtaattttgttatattgttttcttcttatgttgaaaatagttagatcctccattctgatttcttaatttgcatttctttgggggatctacaatgaaattgatggattatgataatcttgattccagatcatattattattaggttacatcataatccataacggatatgccaaacattttaatatcacctatttataacaggttagcacagttttatcaatttatttttggcatgtgaggaatgaggtggggagtcattggtttgcatagcattgcattgtgtataagtaatattttatacatttgtttgggatttcatctgttttatcctttgtaatgagatattttcccatgagtggtgactctgctattagaatcaatttgctagcctgtgaggatcttggattttgagtggaagtataacaagtaagcctgcattcttttttctcttttgtcttttttaagtgaattaaacgtggaacaaatttatctgataggacgtgacattaatgaaaataaaaatttgtttattcttgcctaatcttaatttttatgatgatgtttaccaactcctatggtagactccttcacatttaccagacagacctcaacatttttctataaacaagacccttcctttcttgtcccatttatttatctatttattattggaatggactcatgaattcctgtttttttcccaatgatttataattcactaatgtttttaaccactttggtgctcacattgtccaagatttggccagtaggagaggcttcaagctagctcttttgtttatgtgacacacctatcattttgtgaatacttccttactttctggtataagaagatatttcaggctcatcttattcctcttctgcctcagttgtggaatcagctgtatatccttttggagctctagttccttgtaatggaatatcatattagagaccaagatcttggtgctaggtatgctttttgctctttgaggtatctttacttagtgggttgtttggtgaacaaagttaggaaataataatttatttatgtgcacatataaatatacatatgtgcacatacatgcatacatatgcatgtatatacacacatataaatattttagaaagcatttcttcataccaaaacttccaattcggatctatttctgcaaggcttttgtaccttctccggctcagtatttgttccttcttctacagtaaatgaacactgacttccaatgacatcaacatatttacttgtttgctcaattctatattgtaatctaaaatagtttcagatttactttgcttatatcacttcagtaagaaaacctacataaaagattctggaatctgatttcaagcttccctcctccaccttgccctgcaccaattcggagtatgtagtcaaattttgggttcctaagttactttgaaccttccttccctccctcttctcttactccctcccttcctttcttctttcattccttttttccctcttctcttcttccccttacctctcctcctatttccctccttttttactttctttttccatcaatatagagataggattcacttgaagtttattaggctcttatttctacttacttctaattttatgaattttttcctttcccattcttattgtattaaaataattaattaaatatgttgaacattaataacctgaaactacttccagtatactcagagagattattgttcatttctttctccctcttccagtaggtaaccaattttattgttttctggtttatccttcccatctttcctttcataaaagtaaagctgtatgagctgtgtgtgtttctgtctatgtgcgtatcttatatttatatatatagttattatttcaccttcttacacaaaagctgacatattattagatgtattttagatactcttttgagttttacattttttttcttctttataatacttcctggagctcagttaatatcagctcataaaaatgttcatttttttgttctgttttgtttagagatgtatagtattccattatgcatatgtaccataggttaacaaatctattcggggacatttagacatttttctggtattttgcaattaaaattacgctacactgaataaactcgtatgtatgtagttttataatattggaggtttttcttaagagcaaattcctttcaatgggattgttgggtcgaagaatacatgcatatgtagttttttagatattgtcaagttgtcctccatatgaattttctcattttctattcctactagcccacatgggatggcctattcatctacagactcataagcaggatatattgctatgcatctgaaattttgccagtcttgtggagaataatttgtgtagttttaatttatatttccattattataagtgaagttgaatatttttcatgtggttaagagccatttttatatcacttttgtgaattgtctcttcatgtattttgccagtttttctataaaattattagtttcccccttatttttaaagagttctttatgaattagggattatagctctttttcagtgagacataagttgcacatatttcctcccagtttgtcatatgtttcttgacagtactaattgcactttttttttttgctatgcagctttcttaaggtagtcatatttcttagtcttttaaaaattacatttggaattttattcatggttaggaagccttttattttgtaattaattatgtaattaacttgtcctttattatgtaaaggttttattatgtaattaacatcctttttttactatatcgaaaattttattttttacgtttagatttatgcttcatttagagttttattttgtttatggtatgaggattggatctgatttgatagttttacaatagctatcaagttgtcttaatttattatgaggactgtcttactccagtcatttaagacaacttttatcatttactagatttttagcatgtgatagttgagcctgtttctggaatttctattgtacacatttggtctatttatgtgctagtaccatactatttaattatagagactttgagtatattttatatcttttaggtctacctctcttcaaagctcatctttttcagtgtttttctaattattcttgtatgtttacttttgtccctaagcattgagatcaacttttctagctcctataaaatctcattggagttttcattgaatcacattaaagttaaagattatctttgaaattaattgctattctgatgatgttgaggtgtcctacaaaagaataaataatgtctttccacttatttacatctacttttgtctttttcaagctgagtttcatacccaaaatcatattgttatgtttttatagaaagtatttatttcattagctttttggaggtacctgtgtttccttaaatgacacatggaattaaactaccaaaaattggtgtttaaatttaactcataaaatttgaaaaccattttaatacattcaaaattatttcaaaaattattatttgttaatataaaccactttagataatatatgtttctaatttgcttttttgagctataaatatttaatagagaatgtagttcttgtattggacaccttccagaattctgcaaagtctttcagtttgattcttaacaaggtggtgttggtttgttttttctgttaattttctgtgcttgactattgaaaacttagaattgggatgccaaagttacttcctacacaagaacatatagtttcatccttccaagaaatttgtagtttagagaaaataaaatttcaaccattcctttgtaaaacttatactgtgttgaaggtaaatatattatagtaattttcagttcaatatatgattatgtaatttgaataaaccaaatattgttaacaaaaaagaaaatgttataactttcatattagagaaatgagtttgtatccttgagctttttaagtcaatatctcagtattatcactttgaaaacacttgagggagagtgataccagcaagatggcagaataggagataacctactaatatttcttcacaacaacaagaactctgcacttatctactgacaaaagtcactggcaggagcctcaggagtcaggtaggagggtgtgaaagcccactggagcccaaggcccaaagagggttgttttgagaatgcagactggcacccaggtaatagatgcattaattttgcttccaggttcaagcccagaaatggccctgatccccaagggatttgactacagccctgtttggccttgagcctgcaactaaaatcatcttctaaggggtctaggagcaatcatgtgtactagtgtaagagacttgtttgcccactgatatcagtctctgcagtgaacctagaagtagtcctgtggctcgactccagccctctacagttgagttcccagcacagaactgctcacacaaaaccccagagggagacttgcccatatcctgcagattgtgagtctgagcctccttgataggcttgccaaacttatctttcagtagtacccaggttgtcatctcacagcacatcctgagggatccagtctgacccccagctccccccactgtagtcaggtaactatcatatctgtgcagggacctgctaggagatgtgcaaccatctgaggaattgaggtgggctatccaacctttgtcccacagtagatcctgaggggacccagcctcagatttggcccctcctgctgcagttggtgacatatctctcacctgttcagagacctcctgggaggcatgattgtctggggcactgggatagtcttctgggctaggtttcctggccagctttcccacacagcccagttaccctccttggatcttccctaggtccatctgccctgcagagccctgccaaccttggagccctcctgagacttgtggcagatatgggcttagactgccctctagtgtttagggagttgcagtggtcatgggctcagagaacacaacagtcagtccccttagaaactctggaaggccctctgaagaaggatgagcaaaaacaaaactagactaggaagactggaataaacacctgatctctcagtgcacacacattgttgcatgtccataagcatcaagatcattcagggaaatctgatctcaccaaacagacaaaataaggtgccagagactggccctaaggtgatggagacatgtggtctttcagacaaagaattcaaaatagctgtttttagaaagttcaataaatttactgaagctcaaacttcagtaaaattcagagaagcaatcagaaatacatgaacaaaacttaagagattgaaatattaataataaaaacaaatggaaatcctggaggtgaatgaaatgaatgagtgaaatgaaatacaatgaatgaaataaaaatggaatagagagcatcatcagcacaatagatcaaacaaaagaaagaattagtgagttcaaaggtaggctatttgagaacatagtcagaggtgaaagaaccaaaagaatgaaaagggccaaagaaagcttaccagatctgtgggacaacatcaaaataacacatttgtgttattagaattcaagaaggagttgagagacaaaggggccaaaaacttattaaaaataataacagaaaacttttcaagcctggggaaagatgtgaatgcccaattatagcaaagtcaaaggtcaccagattcaatcccaataagaataccacaaggcatgtcacaattaaactcacaaagatcaatgactaagagagggtctagaaagaagtgagaaaaaagaagcaaataacatttaagagagatctaatataactggcagcatatttctcagcagaaacctttcagggcaggagggaatgtgacaatatattcagaatgtggaaggaaactacctgccaaccaagaatactataggcagaaaaggtgtattttaaaaatgaaggagagaaggacttctgcagacaaacaaaagctgagggaattaatggccaccagaccaattctgcaaaaaatgctgaagagagctcttcaaacttaaagaaaagaatacttacattgattgttaggctaatactgtaattttgttgtataaaccacatttatctttgtataaagaatgaacgacaaaactataaaaaactacaataatttgttaagagatagacaatatgaaaaatataagctgtgacatcaaaattcaaaatatggaaggataatgagttaaaatgtaccatttttgttgttttcttctttcctttgcgatcaaaattaagtttttattggtttaaaataacttattatgactataagatgtttttgtgagtctcatggtaatgaaaaagctaaaagctataatagataacactaaaaaagtaaggaataaaacacattactagagtgaatcacataaccacaaaggaagcctttaagagaggaaaaaaggaaaaaatatctagacaactaaaaaagaagttacacaatcgtgatagtcatcccttacctatcaataactaccttgaatgtaaatggttgaaattattcagttaaaagagaggctgaacggatagaaaaatatgaccaaactatgctgcctacaggagacttactttacgtataaaacaacatgcatagattgaaagtaaatggatgggaaaagctatttcatggaaatggaaccccaaaaagaacagaagtagctgtaattatatgaacaaaatagactttaagttaaaaactgtaaaaagagacaaggccattatataataatagcaggggtcaatgcagcaagcagatacaattataaacatatatgtgcccactagcagaggacctatgtatataaagcaaatattaatagatttaaagggagagatagactgtaacacaataatagtaggggacttcaacactccactttcagcaatgtgcagatcgtccagacagaaaatcaacaaagaaacttcagtgtcagacaacactcttgaccaaatggacctaacagacatttacagagcattcggtctaacagctgcagaaggcacagtcttctcaacagcacatgtaacattgtttaagatagattatatgtaagggcacaaaacatgtcttaacaatttttttttttttttttttttgagacagagtctcactgttgtcacccaggctggaatgcaatggtgctatctcggcttagtgcaacctccgcctcccaggttccagcaattctcctgccttggcttcctgagttgctgtgattacaggtgcctgccaccatgcctggctaatttttgtatttttagtagagacggggtttcaccatgttagccaggctggtctcgaactcctgaccttaggtgatccacctgcctcggcctcccaaagtgctgggattacaggcatgagccatggcggcctggcctcaaatttttaaaaatcaaagtcatatcaagtattttttttctgaccactgtggaataaaactaaaaccaataacaggaggaactttggaaactgtatacgtacatggaaattaaacaagtcaatgaagaaattaaaaaggaatttaaaacatttcttgagaaaaatcagaatggaaatacaacataccaaaacttatgggatatagcaaaaacagtttttagaggaaagtttatagcaataatcacctatttgaaaaagtagaaatatctcaaataaacagcctaatgttgtacctcaaagacctagaaaacaagaatgatctaagtccaaaattatgagaaggaaagaaataataaagaacagagaagaaataaaggaaatagagactaaaaatacaaagcatcaagaaaatgaagagttggtttttgaaataagaaacgaaattgacaaagctttagctagcctaagaaaaaaagaggaatgattcaaatgaataaaatcaaagatgaaaaaggagacatcgcaactgataccacagcaatacaaaggatcattagagactataatgagcaatgatagaccaataaatttgaaaactttgaagaaatgaataaatttcttatagcttatcttaccaagattggatcatgaagaaatagaaaacctgggcagaccaataatgagaaacaagattgaatcagtaaaacaaagactcctatcaaaaaaagttcaggacctgacagcttcattgctaaattctagcaaatatttaaaaatgaactcataccaattactatcaaactattccaaaaaattgaagtagagggcattcttccaaactcattctatgaggccagcattaccctgataacaaaaccagacaaagataaaagtataaaataaaactacaggccaatatccctgatggatatagatgcaaaaacccataatacagtactagcaaactgaatccaacaacatattataaggtcattgaccatgatttagtgaaattcatcccagtaatgcaagtacagttcaaaccacaaaaattaataaatgtgttacattgcattactaggatgaaggacaaaaaccataggatcatctcaatagatgctaaaaaaagaatttgataaaatttaacattcctccatgataaaaccgctgaaaaattaggtgtagagggaacacacctcaacatatgtgcacatatatgcatccacagctaacatcataccaaacagggaaaagttgaaagctttccctttgaatgctgaagcaaatgccatagtatgatggcattcctatcaaactatgacattctttacataattagaaaaaattattttaaaattcatatggaatcaaaaaagagctcgagtagccaaggtaatcataaacagaaagaataaagctggggataccatgttaattgacttcaaactatattacaaggctgtggtaaccaaaacaggatggtacttatacaaagacagacacatagaccaatggatcagaatagagagccaagaaataattctgcataggtacaactatctagtcttcaatgaagctgacaaaaacaagtagtgatgaaaggactccctattcaataaatggtgctgtaatacctggctagccatatgcagaagttgaaactggacccctttcttacaccatatacaaaagtcaactcaaaatggattaaagacttaaatgtacgacccaaaactataaaaaccctgaaggataacctagataccattctggatgtaggacctggcaaagatttcatgacgaatatgccaagagtaattgcaacaacaaagaaaattgacaaatggcgcctaattaaactgaagagcttctgcatggcaaacaaaactaccagcagagtaaacagacaccttacaaaataggagaaaatatttgcaaactatgcatcccacaaggatctaatatctagaatctatatggaacttaaatcaacaagcaaaaaacgaacaaccgcattaaaaagtgagcaaagtacatgaacacacacttttcagaagaagacatacatgtgtccaacaagtatgtgaaaaaatgctcaacatcactaaccattagagaaatgcaaatcagaaccacaatatgataccgtctcacaccagtcagaatgggaattatttaaaaaaataacagatgctggcaaggttgcagagaaaaggggaccttatacattgctggtgggattgtaaattagtttagccactgtggaaagcagtttagcaatttctaaaagaactcagagcagagttaccatttgacccagcaatggaacacttgcagctataaaaaaagaacaagatcatgtttttggcagcaacatggatggagctggaggccattatcttaagtgaactaacactgaaggagaaaaccaagtactacatgttctcactttttagttggagctaaacattttgtacatacgaacataaagaagggaacaacagacaccagaacctactggagaggtggaggaagggaggagggtaaagttagaaacaacacctatcaagtattatgcttattacctgggtggtgaaattatctgtaccccaaacctctgtgacacacaatttacctatgtaacaaacctgtgcatgtacctctagtataacctaaaataaaagttaagaaaaatgataggaaaacaataatttattgtacattttaaaataaaacagtgtaattggaaagtttgtgacacaaagaaatgataaatccgtgaggtgatggatgtccttcttaccctgatgtcattattatacaatgtatgcctgtatcaaaatatctatgtaccccataaataagcacacttactatgtacccataaacattaaaaggtaaaaattggccaggtgcggtggctcaaactgtaatcccagcactttgggaggctgaggtgagtgaattgcttgagtccaggagttggagaccagcctggccaacacggcaaaaccctgtcttaagaaaaatacaaaaagctagccaggtgtgatggtgtgtagacccagctactagggaggctgaggtgggagaatcacctgagcacaggagatgaaggctgcagtgagctgagattgcaccactgtattccagcctgggcaaccgagtgagactgtgtctcagaaacaaacaagcaaatgaacaaacaaacaaacaagttaaaaatttaaaaagacacacaaactaatgaaacagaataaagaacccagaaataaatacacgcatgtataccatctgatttttggcaaaaatgccaagaatacacgttagggagataatattttctttaataagtgatgctgggaaaaagtttcattaagaagaatgaaactagaccccatctgtcaccacttaaaaaaaaatcaaaatggattaaagatttaaatgtaagtcctcaaaatgtgagactactggaagagaacacggaggtaacactttattacatttctctggggaaggtttttgtttgtttgttttggaaaacacctcaaaagcacaggcaacaaaagcaaaaatagagaaatgggattacatcaaaacaaaagcttctgtgcagcaaaggaaataatcagcagagcaaagagacaacctatagaatgggagaaaatatttgcaaactatgcatctgataagggattaatatccagatatgttaggaacccaaagaactcaatagcaaaaaaccccacaagtagtaaagagtggacaaaagatctgaatagacatttctcaaaagaagacatacgaatggctcactgatataagaagaagaaactcaacgtcactcatcattaggaaaatgcaaatcaaaatcatgatgagataccacctcacactagttagaatggctgttatgaaaaagacaaaaaaataacaaatactggcgaggttgtggagaaagaggatcttctatccaccgttggtggaaatgcacattaatacagctgtttgtggacaacagtatggaagtttctccaaaaattaaaaacagaatgaaaatatgtttcagtaatctcactactggatatttatccgaaggaattgaaattcgtattttgaagatacatctgtactcttacttttattgcagcactatgtacagtagccaagatatggaatcaatctaagtctgtatcaagagatgaatggataaaaatatgtcatatatttttggaatgtattttatccataaaaataatgaaatcctgtcatttgggacacaacatggatgaacctagaggacattatattatgtgaaataagcacagaagaaaaatactgcatgatctcacttatatgtagactctaaaaagactgatctcatacaagttgagagtagaattgtggttatgagaattgtggttgtgagaagctgtggaggattttgaaaggcttgggagggtatgaggagggtggaatggggagagattggtcaatttatacaaagttacagttagataggaatcacactttgtggtgctctattgcatatttctaaaactagaaaactaccatcaatgacaaaatcttaaaagtggtgtttggaaatgtcacagaaaacctaacacccaaagttcctttgtttcacagagtccttttcttccaagttagtgttttaaaggattatcatattttgactttaattttataattaatatacagtaaaatttactcttcaactcatttttttccatgaatataaaaactagctagcacatggctgaaaaatgcattgggaatgtaatctgattatttagcctctaatttttcactatttgactcttcattatatatatgtattctactattcctctgttcttatgaatgcttctgaaaaactaaagacattttagactcttttacctctttaaacttttaactagagttgaaatatatgtaatatatttatataaaatatgtatgtaataattacttaaaccatatgcaaatataatttttagtatttaaatattaagtcactttattaagttaccctggtgcataaattttataataatttattttggaggacgttccaagaaatgttatgcaaaaccatgctatatctctattagacattgtcaattttatttggcaaacaaggttttgtgaacttgaaaaattttgaaaatacttatgattttctcccactgctgtagttaactatatttttatgtattaaatataagagtacatgagtatggatgcgcatatgttctttcactttttaaaaatctgtttatgtgaattcaaagtttgagctcctgaatttaatctatattagtcaattttgtttgggttagagaaacctttttttccaattatttaccggaggagatctgtttttaaaaatacagattaattggtgtagaaactggtgtagaaaatttttttaactggtgtagaaaatatgttaatttcaaacaataccacaagtgtgaaaataatgtggatttatgaattccctgaattttcttctacctaaaaatatctctgtatcttatttcagactttcacttcttctgtttattaaggcaggatacatatcccaaagctcataattatatttcatctgccttttaacattccttatatgcctatcatgtatgtttattttctttttcttcactatttcatctctcactttttctcatatataaagctttctacaattaattcaaatttcaaacacatctttcaaagatgtgtttttgaaatttcaaataatggtatagttttaaatatgttttgatgtagaatataaatacttttttgcttgaagaaaaacatgaggcttttgaattgcattgtttaatagtaaatgagtttttgtgtttctgcagatgtgactctgaaaatcgctatgttggtaatccacttagaggaacatgttattgtaagtatatgtgtattcttcattttaaataattggtgcatactattagtttcaaataataaaggtcatcttgaataactaaaattgtcatgaatatcttgcaatttctatttcttaaattttataatacaactttacgtatattgctaagaaatatattctcttaattatatttggtacattttttctactctgagcagtaaaatagcaatagattttgttgtgaacatagaacaaagtatagaacttgagtaaactcatgtgattttaatgtagtccttttcattatgatggatttttgaagaacttgaattttataatagatattttgcagaattttgggcattactaaaaggctgcactgattttgtaccaacagatgctttcattgggtactgattatatggtaggtatatatttaacttttgttttgttttctgagatggagtcttgctcttgtcgcccaggctggagtgcaacggcacaatctcagttcactgcaacccctgcctcccaggttcaagtgattctccagcctcagcctcccaagtagctgggattacatgtgcccaccaccacgcccagctaatttttgtattttttgtagagttggggttttgccacgttggtcaggctggtcttgaactcctgacctcatgatccgcccaccttggcctcccaaagtgctgtgattacaggcgtgagccactgcacctagcttatctttaacttttaaagaaacagccaaatgctgtttccccaaatggttgtaccattttacattcccaccagcagtgtatgagagtttcagttcttccacatttcagaaacttttttagagttagtccaagttttagccattctaataggtgtgtaatggtatctaactctcattttaatttgcactttcctaattactaatgatgttcagcatcttttcataggattgtttgccatctgtatattttattcgatgaagggtctgttgaaatcctttgcccactttttagattgtttttatattaacaaattttccacatacttcattctagatacaagtcctttatcagatatatgacttgcaaatattttttactagtggtaacttgtctttttatcttattaacactattttcttgaagaacagattttaatttagatgaagcttgacttatcagtttgttcttttgtgaaatcttagcctaacaggtcactgtgattttccccaggttttggtagaaatattatatttttaagttttctatttaagtatatggtccattttgaattaatatttgcatatatagtaggtgatggattgaagttctttttttctccatgtaaatatttaaatgttcaagcacactttatgtgaagactatactttaatcaatgaatttctgtgcacctttgctgaaaaacacttgtctgtaaatgtgtgggtctgtttctggactcttttctgtttctttaatctatttgcttatttttatgctaacgtagcacatttataattaatgtgattttataagtcctgaaatcggttagtatttattctccaactttgttcttccttttcaaacttgttttgactactctttttttttttgcatttgcaagtgaattttagaatctgcctttcaattttcaaaaaaattgctataatttgttttgtgattttgtttaacttatagatgaatttggggagaattggcatgttaactatagtgagtctttggaattattgtattttttattttttctcaattctttaatttttactattaatattttatagttataactgtacacatatttcacatttttgtcagatttatccctgtatattttaaatttgtgatgctattgataatgttagcttaaaatatttcattcctgatttcctgattgtttctggcatttataattgattttatattggttttacatcctgtagctttgcaaaagtcacattttacttctactaccattttttgttgactctcagaatttctacacatacaatgtttcctgcaaataatagcagttggatttcttttcctctcttgatggttttctttcttttttctgccttattgctatagctagcacctttaataatgtgttgaaaagatgtgaacatgaaagtattattgtcttgtttctgatctaagagggaaagcattcagtcttttatcattaaatatgatgtaggtttttgctaactgcctttatcagattaaggaaattgccttctattcctactttgctgtacattttttatcagaaatggttgtttatgtccaatgcatttcctgcattaatttatatgattatcagaaatttctattttactttgttaatatagtgattttagtatttttaatttaatgaacggtatacagtataagaatatactaccatttttgtccattcataagttcatggacattgggatttttttctaggttttgtcattaagaaaaatgctgcagtgaatgaacattcatatggtctttatgtgaacatatgtttttattttccttgggtagattcctagcaatgtatagtttggttgtatgataagcttttgcttaactactttagaaactgccaaatggttttccagaatgttggtaacattttttaatttattctagaaaattttgatactagaaatttcattccttgacatcctcatcaatacaacattgtctctttgatcatagacattctagagtgtgtatagtggcattttgtggttttgttttgtatttctttaatgactaatagtgttgaacttgattttatgtgttgatgccttgaaaatgatttgctgggtgtgtaaaatttatccttttttcagtttttgttgctgttttaaattgtatttttcaaaattttgttttctactcttgtttgatatataaaaataaaattcgttttagtatattgatcttatattcattaactttggtgaacgcttactaaattctgtttgtagatttgcttggatttttaaatgcagttaattatattacatgaaaataagcacaattttcttcctttttcaatattttttacccttattgggatgttgagacctctatttctgggctgaatcacagtgatgataatagatatccttatcaggtaggatgtttattataatttatggaatattccttgtatcacattaagcaaattcctatcttattttgtgacaaggttatatcatgaataactttcttttaccttattaaatactaagttaaattaatagattttctcacattaaacatcttttcattctgggctaaaccatacttagtcatggcatattagtatttggatactgctaaatattagttgtttatattttaatttagaatatttttagtatgaaagaagacgatctcttttttgaatgttattttttctgactaaatgacctatgactgcagtttttaaaaattattttctggccgggcgctgtggctcacacctgtaatcccagcactttgggaggccacaaagggcgaatcacgaggtcaggagatcgagaccatcctggctaacgcgttgaaaccccgtctctactaaaaatacaaaaacaaaattagccgggcgtggtggcgggcgcctgtagtcccagctactccggagactgagatgggagaatgtcatgaacccgggaggcggagcttgcagtgagccgagatcgcgccactgcactccagcctgggtggcagagtgagactctgtctcaaaaaacaacaacaaaaaagttttccattctatatatctgcaattgtggtaaaagcttttaaaaatgaatttggaacaattgctatcttcttttaaaacaggaatagttaaaactttaaataaaaattaggtatttcaacaaaaatttttgggtctagtgctttttaattggtagttattttatttttttattttttgctatttcatagcattagcttttggttttatttatcttttctgtggatcttgttttttagttcatcaatttcagattttgtctttaataatttccttctcatatactgtttgttgttgttttgcctatatttgctatagtattttaaaattatcatttttttacagaatttatgaattccttttttatctttaaaaacgtaattattttcttagttcctttcttaagtgattcttattttttaacttttattttaggctcagggctgcatgtgctgcctgttatataggtaaattgcatgttgtgggggtttggtatacagattatttcatctcccaggtaataagtgcagtacttgataggtagtttttagatcctcaccctcctccaatccacaaaacatttgttaactatttttaattttttaaaaatgttactgagaatgtggcatataaaatcccaaattttgttaaggtatttttgccctttatgacacatttgatagggtatggaggcaattttgtttgtcacaacaggggagtgggacgtgggtgccgtgggcatctcatgggtagaggctagggatgctggtaaacatcctgcaatgaaaaggtcaacctccccagaacaaaaaatcatgtggccaaaaatatcaatagtatttaggttgagaaatcctgatttagaggcttaatcaaatttatatctgattttggagaaaataataattgtagatggtttggttttctttgtctagaagagtcatatcatgtctgttagtgtctcttatgttcttggcacacactgacgctcaatgtttagattttaattgatcaagattgaaaagatataatattctgccaggcacagtggctcacgcctgtaatgccaacactttgggaggccgaggcgggcgaatcacctgaggtagggagttcgagaccagcctgaccaacatggagaaacccgtctctactaaaaatacaaaattagctgggcgtggtggtgtgcgcctgtaatcccagctatgtgggaggctgaggcaggagaatcgcttgaacctgggaggtggtggaggttgcggagaactgagattgtgccattgcactcgcacctgggcaacaagagtgaaactaaaaaaaaaaaaaaaaaagaaaagaaaagatataatattccaatttcttcttcatgttttggtttgaatacttcggtaaaaacaaattttcgctcatcagctgtttggttgcttattgctacagttcgcatagggaaggcatgataaatgttacagtttttccctgtattttttatttattccctttactacttttatgtatgtatttatttatttaaaattaaaagttagctcaatatctttcaaaaatgacagtttttgtcactaatgaacttatagatccatacatgttttaatccgtgtgcaattattattcctactgatgctcagactgtccaattactgtgtcatttaaattatctttattctctagcttttccacatcatttttgtttttcttatttcaaatatcctggatttattttatagggatttttttctttggttttttaaaattagaaattcctctttttttgagcctttagtttcttttatctgccaaaggagtaactagttaccattatgaacacattatgtaatctctgtttattacaaatatactaatgtttaacccttttataaaaactagcataatttttcttctatgtcaatgttgtccaatacaaatatgatgtgagcctcatatgtaatttaaaattttctagtagcttcctttaaaaagtaaaagaaaatgagtaaaattaatgttaataaaaccttttttagcttaacacatctaaaattttttcattttaatgtgtaatcagttttaaaagtcattaagtcattaatgagatatcttactttttttgtactagtgtttgaaacaaagtttacattccatacttacatcacattttaattcaaatcagttacttttcaactagtcaatagccacatatggctagtggtgaccttattggacaactcttctctagattacataggatccctgcgttcttttagaaatatcagaagcataatggtaaagcactaggtggcactcttggtattgctgtgagacgtttaaagcttaatatttgaaaagaagtgatgcttaaaaaagaaaaggacaataactcttgtaataatgttaatagaaactattctaattttcaagattagatcgaaatttaagatgcaagtccacactgtaacttaaagcaattgagtgcaatgtggtattaacttaattgaaagtgatatgtcagcagttgtaatctatttacttagtagtttttcaaagttcattttaaaaccaaaaaccaaatatattataaagcatgcctcacaaaggagggaaaacgttcaaacagtgttaactaattttattggcccttgtaaacattgaattactcaatatatttttagtaaatacaaaaagtagtagtcacaaagtatcacaaagtagtatagtttttttttcttaaatgctttcttttaattgtaataacaattttaacaaagaaaaccttaaaaatgaaagactaggctgtagaaatgctatatagatgatatatttcaaaaagtagaatgagagtacataaagtcactttctgcagtcatttactttatttcactattgtgctaattctttaaatacatgtaatttgcaatgctcacacccctaattattgtgttttaatatacttccaagtaattgaacacattttatttcatcttttactctttaaaaaattactgttttatgttgaatttcttttattagagtttcttttatttagagttcatggtggaattttgtagtaataataaactacctattttgagagtaggaaatttaagttgaaaaagatgacttaaaatagtatgtcagtttaattacttaaaatagtatgtcatagaaaacaatgaaaccaattaatacttgaattgacccttatatttaatggaattatcctggtttttgttctaaaactgaataaaataattttcctgttttaaactgaacattttgttagtgaatgttttatatgactttttaactattggctataaattgctatttaagtaggatctggctgtttcatttgcacatggggcagagtgatcttaataaacaccaataatctaaattcttatatttaccagattgcagacatgatggattgaacagtatctgacaagacataaatgagtcacatttttggcattttaaccttgttctttgattcctcagtatttttattaaattttctgaagtctgtatccctgtacttttagatttttatttcagaactatttactcctttagcatagtccaaaatgatggataataaacatgattataagaaaatttaaaatagctaaaaggaaaaaaattgctattaagttaatgtagaagaaggatgaaaatttatttgacttatatattttacaataaaagtgttacattattattttcatgtaaaatcatagactcactgtaaaaaataataaaaaagtttaaggaaggaaataaaaatgtccataaaccttccaccaggtcccccaagttgagttgtgtagtatgtatcctttgtaagggtactcagctgagtggaagattgagagctgatatgctgtacttacctttctcactaagccatgtaccctagtgtggggctgtgtctgccttgagccagaggtatatagttctttatttgtgtgtaaaatgttgaatggtctactgaagggactgcctgccttctaaataaatctctgcatcatgtcctgagaatgattttatgtcatagaggtcataacatgcataatattattgtgaatgtttttcttatagatatatagctcattattagcatttagtaaataaaacatagtttttcccaaactggaaaagaacaaccacctgactttaaaataatgatcatactagttaacatttattgagaacttactatactagactgttctcagctttttatatgtattagcttatgtaatactcaaatgggaagggtatgcttattattcccattttatagataagaaaacagagatagagaaagctgaactaatttgtataagatcacacaggaaatagtaaaggcaggtttcaaccctcttaaccattaaagaagtggaaatcagtggtatatgtaagcaaaaagtttttatatgagtgaaataaaaacattatgctgaaggaaataagaggatctaaataattaaaaaatcatatgccattttttcaaataagaaatattcatccaaagatatcataacttcccaaaattgatataaaaattttatgtaattccattatagaatttcattcaattttttctgaaaggcatgcattccaataaattaccttaaggttcaagttaaataatacacttttagaatatccagttagattacaaacaggaagaatagtaagaaattcctactttaatagatatccaaacaaactgtaactctaactgcatccactggctcccaaacttgtattagaatatgccactaaatcaatgaacaagttggagtataagattaagttcctgataatttgggaatttatatggtactatggtttgaatgtttgttgcctccaaaattcatgctgaagtttaattgacattttaacagtattaaaacctgggactttttttttttttttttttgtgacggagtcttgctctgtcgcccaggctggagtgtggtggcccaatctgcaagctccgcctcctgggttcatgccattctcctgcctcctgagtagttgggattacaggcacccaccaccatgcctggctaattttgtttttgtatttttagtagagacggggtttcaccgtgttagccaggatggtcttgatctcctgacctcatgatccgcccttctcggcctcccaaagtgctgggattgggacctttaagaggtgactaggccatgaaaactccaccctcataggtggaatttgtgctgttattgaaaggcaacttcagttccttcttgttctctcttgccctttggccttctgccatgggatgacacagcaagaaggccctcaccagatgccagctgtttggtcttctactttccagccttcagaactgtgagcccataaatttatatttattataaattacccagtatgtggtattttgtggtattctgttatagcagcacaaaacaggctaagacatatggcaagtcattttatttgtatgtctttaatgacttaatttgcttgttcttagatatctcaaactttacgaagattatggctttcgcatttactacttttctctctcaagtactctatccccagctaatattccaaacctaacaaaaatgactcttccagatatcacaaaccttttgtttccatcctaacacttacatagtataaaattatctcagttgatttctgtttttaacttgaatttaggtttttaagtaaaatgaaattttactagaatcaaattctgtgaacactgtaccttgttttattggatctccatacttagaaatctgtatgactcataacagaccttcagttatgtttaatggtagtagactcatataagttattaatacataagtgaatatacatttattttagctgtatgagcaagcatttttattgttggggtacttgagcaaaaatgtccagagatcatattgtagattatcaagtaaaagttgctttaagtttattacggacatagggtaatactattatatcactgaaaaactttaagtatcagtcttttatttaaagaaaaaatgaatttcaaggtttgttttcttcattgaacatttctttcaaatgaaactaaatagatgaccattcatcattgcaggataattgaaagtttagtgattttgagctattatgaagtaaaaaaaggtggcttctgaataggtcatggcatattattaaaaatcccataaattagaaaaattaatgtatggcattggtgataatcatccattcttatgtatttaaaaaatttatttgtaagactgaatgaatttaaatgtatatcttaggtcatacaattagtagttttcagagtttggattataactgtgttttttctatgatatgatatctagcaaatgctgaacctacaaaacttgtgcaacagattttacttttgaaattgttctaaatgttccagattcagtagaaattcttaataattttcagcatggatagtacagttgagcaaacaaggaaaaactagtatttattaaatatttatgtacaaaacaattttatattaataatttcagtattcccaagggtgacatattttttctcattaaattactttctggaggattcgactgttagagcttggagagactgtcatttacttgcgtttactgacttgtgtttattcattctacatttacttattgactagctactttgttagactccatggataacaaagtgaacaaaatgttttttcctctattgaagcttatacactactagagaaaatagatattaaaccagttatatgattttcataggtgtgattttcgtaagagctctgaatgagaattatagagttttgggaatgtatttccaaactttatagagctttgggaatacattacaagagggcctgacctaatttgtgggatagggagtaggtgaggtaagggaatgattgagctttgatttgaagaaatgacttgataagatgtgatagtgtgagggtagataggaagaagtggaaccaaaaaggacagcatgtacaaaggttcgtgactagaaagaacatgcaatgtttgagttactaaaagaaaaccaatactgaaacacatagaatatacagagcaaaaataggaagcttatgagatctgcaagatccaaacaatgctatgctttatagaacatgtaagatacggtctttatcataagaaagataggacgccattgaagggtatttagaggagagaaaaatgttacattttgcttttaaaataatcagtctgctttcagtatgtaaaacagcttagtggcggcaatagagcatgaaatagaccatttttggtttattttttgaggcatcttcctggagctatctgtaaaatatcattacagcacattgagactgttaaaatacttgtacttttattcacatgggtttttatcatttactaaacaattgtctaagtttgcaaatagttgtatttataatcgtaccattgtttaaatgtttttggactctcgatattgttgtcaaagtctgtatgtatcctttatagactcctcaggatggctgactataagatcataaacatatgtttattaacaaacatatgaatataaataaacatacatatgggaatctgacttttgaaatccttcagaattcattcagaaataactacagtgaataaggcagtgaaataactttatcgaatgcctttattttatcagacagtcttctctaaggcaaatacatactcacacaattacatttaattcacagagcagtcctatgacataggcggttttatccctgttgtaccattgggtctcattaagcttagttaacttgtataaaataacctagttgttatatgggagattacaaccaagatctccttaaatggtatagatgatgctaaattaaaactgaaacgcaatattaactgaatcattaactcagtggaaaagcaaattattaagctgcagtttgtttctcaaaaaattcacatataaaatttcagaaacaattcaaaatttatatctaagaattcttcttcccaaataagttgaaatttacatgagcagtgccattgatacagcatatgcaaatcaggcttatttttatttgtcatcctaacatgcctgccatcttgcatctcagatataaagatatttccagtatacaccttgatgattttttttatcactggttactatcttcttaaaaaatacattatttcctgcagattttgttgcaagagtaaagcaaatcttaaatattcactacttgctcttcatcatcccaagcatgtaatgtactcagaaactttcttcttagtttctctttcaaaatgtctttttatgcatatacattttagtcatcactttccacctaatcattagtttttaatatctgacttctttaaacatcttgtatacgttaaaagccttttctctttatatatttttgcttaaactcctttttcatgcaatgtgttttactcatcagcttcatttagtatataatttgttcttgtagtaaatagaaaacacttttttgcactacggctgctagaccagtattgactaaataaccttaaaaaaatcaacttctgcatgttgaaacttaatcctgggcatattccagtcatataagactaggatgagagactgattatcttgtatgtttttgttagcctatatctaagaagtttgtgtattaagaatgaaatatgccatttttggagagaaacataactacagttgacccttgaaccccctgaggtatagaggcaccaaccccgcatgtagtcgaaaatctgcgtatatctttttactctccctgaacttaactactaataggatactgttggccagaaaccttaccaataacataaacagttgattcacatatattttgtatgttatatacattatatattgtattcttgacagtaaagtaagctagagaaaagaaaatgtattaagaaaataataaggaagagaaaatatatttagtattcattaagtagaagtggaaatggatcgtcataaaggtcttcattctcaacgtcatcatgttgagtagactgaggatgaggaagaggaggggttggtcttcctgtctcagaggtggcacaggtagaaaaaaattcacatatgagtggacttgcatagctcaaacctgtgttgtatagggtcatctgtatatcaatctaattatttaatatgtaagtatacatcatgtgaaaaacatgttgaagatcaaggattaaaacaaagaaactctctgaacattggtttacattttttttggcccaatagtggaaatactgcatgttcattctagaaaagagataaataaaaataaaaataaaaattactaatttttctacctagagaaaattgttgctaaattgtactagttttccagtcatttatttatgtattgatactctgtgttagggtgagtaatgcaccccgaaagatgtctacatcctccccagaacctgtgatacatacttaccttaaatgataagaaggagttacatatgcttaaactaaggattttcagagagactattctggactatcctggtatactcagtgtaataacaagtattcttatgaaagggaagcggaggaaatttgactacagtagtaggagatgtgatgatggaagcaagtggagagatgtgaaggaagggaccatgagccaacaaatgaggacaggctttggaagctggaaaaggcaacttttaccatacattgattattcttatatgaaagaattattattaatgtgtttaccaaatgatgattttctatttcatcatttgttttacattattaactgtaagggagagctgttccttctccttcctcattaatttgtttaattatttatttatatcggtatgaactcatggatatctatttaattttatgatttataagaaattactgtcgttatttattttgtagctgaaattgttccagatctggtcattaagatccccctcaatttggcttctgtgttttttaacataactccatcatttgttgagtgcatccttattttctagcactacaagatatttcgggcttaccttgtactttccctcttccatccctgaaatcaactagttcccatttccccaagatgccatggtttcttatattggagaataatatttagaaaccaaaactggggattatatatgctcattggttctggggttttattctttctttcttttaaaaattttatgggtttcctgacccatgcactagggtataacaatggtattacccgataccttgtcattaataacatcacctatgaaataccaaattcaaatatcttacacctttagtccttcttgctcactaagtaccaatgccataattattcaaactcattgaaatttgtaattcattaaccctacttgttttctcattttcaccctttcctagtgccctgctgtcttcttttatacccttaaccatgtgaggttttatgccattatagttatcagtccttagctaaaactgcatattttcttcccactcctgtttcttctatctacttgtgtagcaaaatccaaactggttaatccaactcttcactactctgtgtctgaactttcttcaccctcacgttgctggggggaaaaaaaaatcatatagctgtgttgactgtttggtcttgagctttatcaaaggaaaatgcaaaactacctggtgtttttcctgcatttcctttataatactctccaaataagtgttttaaaacttcatctctattctcaaacctttatctgcaccagctaataattttacctcctacttcattgagaaaatataagcaaatagatgcgaatgttcccatttttttttaccaccacaatcaccaaacttttttgcacctatacttattttctctgcctttagtttattatcgaggaaagaataactctgttcctaacaaaagcctatttttcaatttgttttgctctaaattttatacctttaactctttaagggactttgctcttccatttctgctttatcaacagttgcttagactctactggaccaatttccttagcacacatatacatgttttaatatatcttatgttaaaaataaaatttttctactccccttatacttctccaactattgcaccatttctgtattttctttcagatcaacccttctcaaaatagttgcctaaacttgtcaccaaatccttaccacccatttcctcttcaatccccacaactccatagacattgcttttctaaggaaacataccacagagtcgaacagttgaaacagtctatttcttgactttcctatcatactttccaatttttcctactctgtcactgactgcacctttttagtcttttttacttttttttccacttgaccttatcagttcccatagttttaagaagcatctaaattttgatgttccaaaacttgtagttttgatcacttttctgagctgcaaactgatttctctgactttctgtttgatatcatcatttagatattttattagaaagtcatattcagtattttcaaaacagaactctaagtttttcctcattttataaaacttcattctttactcagacttcctcatttcagtaaatgtacataatgcctatatacttgcttttgtcaaatatctgaaagccttctttgattcctgattccaaagacttctttgagcccccctctctgatacctttcctttctcaacccttactttgtgagggtgtttagtacttcagttggatttccttatacaatatatcccaaagatatatatctttctctcttctacttctcccaccctgtccaaggcactgtcattttgactctggtcctttttagaagcttccttgtgtagttttcccattttcagttttaattttcttcagacattctccaatcggccaccagggtgacatttaaaaattaaaaatcagaccatctcactacccagcttgagatctttcatggttttccatgatgtggcccttacctgctttctgactttatctcttacaaccctccacaaatcattctaagcacagtggaattatttttttttcctcaaacagcgcagcttcattttcatttgtgtttgctctctctctctctctctctctctctctctctctgtgtgtatgtgtgtgtgtaaacaatcaggaactttttcactgtaaacaatcaggaactttttcactgattgtttacatgatttgcttctcatttttcatttatcatttcagatgttgtttccttttgtgtgccttttgtaaagcaatcttctctgaacctgtaatagggattggtaagcttttgctgtaaagggccaaataatagatattttaggcatgacaggccagatggtctctgttgttcctactaaactctgccactgtagtagacaagcaaccatagacaatatgtaaatgattggttgcggctgtgttatcataaactatctacagaaacaggctgtggaccagatttggtctgtgggcagtaatttgtaacacctattccaaaacattaccttgcgatcttcatagcatatatcactctcttaaaatgtcttgtttatttgtgtgattatttttggctttctcttctattaatagaatgcaaactccataggaacaaggcctttgattcctcacttctatctgtctataattctgattggaattttattaatttaaaagattaatctgaggagaacatatatatattttcttaagtattaaaatttagaatgctccttagcagtctatttatcatgtatagttacatcttcttttatgacctaaaatagattttgtagttttgtaaattaaattttttgtagttttgtaaattaatatttagtttatttctgggatttcatttggtttggagatttttattagtttgctattcagaatggaatttttaaaccattacattttctgttgaatgtaaaacctctattgatgtaaaagaaaagctattgatgattatatgtgtttaaatttttgcatttttttggtgatttgatatcatcaaattattctgttgatgatttatagtgatgccattaatgacaaatttttggtctcaaagtctataattgaaataaatgtaattacacctgtttcttttgattagcatttgcctgatgtgtctcccttcatcctttcagtctgtgggctctctttttataggcatatctcttaaaaatagaagactttgattttgctgttttctaatctgtacatttttgtgattaatgatgagttgaatccatttatttttggtgttattattcatatctgaatctatttataccattttaattttttattttgtatttttactttttatatatttgtttttaagccttttatagcttttttggaaggggaaacatactgatatccccctcctataagataaggattttagcattctgtaactttttttgaaattcttttataaaaccacagtgttttgatattctctagactttctattcttggttattatggatacgcatgtttctttggacatcgcaatttttacaaagataacaaattcaccaaggtattttatcagccccatctccgtatcccttgatatattttttgctacacattctgtatttatctcttctctttttaagtctttaatcaaaaattgttttaacggaagtctgcatgtcaaagcttctgaattctctatgcctcagagtatttattattccttcctatttgagtgtatgcaactaataaagtagacttaatatgtggagcaaaaattgattaaactacaataaaaaattaaacatacctctttagagtatttctagatcaagcagacaaaattcagaaagaatatcaaagatctgaagaacacagttaatagaaatatgaattatagccataaagatttaaaagaggatttaaatttgcatttattttacagatgatataattgtttccataagaaatcgaagtgtctacaggcaaattattagaaataacaggaatgtttgtcaggttgttggatacaaaattaatattaaattgccttcttagacatgttcctctaccagctgttagggctaactagatagttacagtaattaaggcagtgtagagttgtttttcttttgttttttggtgcagggataggcatagtcactgaagtaataagataatctccaaataaaaggtataggtatttatatattaatatttaagtcatatctggctacattactgaattgtttattatttaatagctttttagttgttttatattaatttcttggtaaactgattctaggcagaaaaagacaactttgttttctttttaaaaatattcatatttctgtataattatatttttgtaatttacctctgtcatctattcaccttttttctttgccatttttgtatttgtatttgtctcttagttgtaatgtgtgtgtgagttgattttttttttcaaaactgatatgtagattatgtccttttaggacacctgtttacctgaaattattttattttattttattttatttttgaggtggatagagcaagatatttatatcttgctctgtcacccaggaaggaatacagtggtgccatcttggctcattgcaacttccgcctctcgggttcatgcgattctcctgcctcagcctcctgagaagctgggattacaggtgtgcgccaccacgccagcctatttttgtatttttagtagagatggggtttcaccatgttggccaggctggtctcgaactcctgacctcaggtgatctgcccgccttggcctcccaaagtgctgggattacaggcttgagccactgcacccgaccctgaaattattattatattgttcttgaatggggacagcattgctgagtatatattttccataaatattacttcttttttttattttgacatttatttctgcttaagagcacttggctgctgggcaaaatggcttatgcctgtaatcctagcactttgggagactgagacgggtagatcacctgaggtcaggagtttgagaccagcctggccaacatggcaaaaccccatctctactaaaaatacaaaaacaattagcaggatgtgggggcacacgcctgtaatcccagttactcaggagctgaggcacaagaattgcttgaacctgggaggcagaggctgcagtgagccaagagtgtgccactgcactccagcctgggtgacagagtgagatttcgcctcaaaaaaaaaaaaaaaaaaaaaaaaaaaaagccttggcatgttgcctaatcctactctgtaaataactcatttgtccgtgtgtgtgtgtgtgtgtgtgtgtgtgtgtgtgtgtgtgtgtgtgtacacttacctacatggacatgcctggatgtctgtaattttttttaacaataacttcatagagatatattcacaaaccataaaagtcaccattttaaagtgtacaattcagtagcttttagtatattatacacagttgtgcaacgatctgcaccatctaattttggaacatttttatcgctccagaaagaaagctgtacatgtcagcagtcacttatcattcttttttcaccagctagtggctaccatttatcttctttttgtctgtatggatttgtctattttggacataacaaaataaatcagtcttttgtgactgatttctttcattagcacagtatttttgaagtttattcatgttatagcagaaatcattactttatttctttttatgacaaaataatattttattgtgtgaacatatcacattttgtttaccattcagttgaggtacatgggttgtttttacattttggctaatttgaataatattggtgtaatataatatgctttttatatttatacaagatacttcctttaaatatttaggttttcttcatcaacagatttttttctttatttaatatatgtgctacccttcaactcattatgatctctgctttaactacattagtcatgcatacactgaatttttctgtgtatcatttctcttgagtgattttcatctctatttctattttgggaggctttttcgtatttgacctacatagcactatttcagtcttatgttgtattaattattctgttttctgattctcgtattaactttttaaattttgccattacattattacttttttgttcttccttttgtaatttatttagctctctttttattgtaatctttggtgttattatctcatctttcatctttaattttgtggagtcagtgttttttagattttattttctcttgacatgttccccatgggtattttaaatagctaaaaaaactctgtatttatattaattgtatctacttcatctgttgttgtcaaattgagattttgctctttttctcttcttaccattgcaagtcaaaataatgtaagaaaagcaaaaatgtttactacttttcctatgtttttgtttttatgatttaaaaaacatatgcaattggaatttggagcctgaagtatgaatggttttgtattctcctgaagctctacgaagctcatacaaaaagtgagaagtgtaaataagagaggtctttctttatatctattttacctatttttataaactatttttatataaaattgggaaattaattgtggatctccgattttcttggatttatgagaggtggtttgcttggatttatgaaaggtggtttgctgattgttcgccaaaatatttaaaagcagatacatatatcatttaaagtggttctaacctctgggctcagtctttaaaatcaaaaggttgatttatagatacttacagctttgattcttcaagccttgaaatacagctatttagtatttttttctattaacaaagttttccaaaaggtgttcctagcatatttaaacataaagaatagtttatctttttttaagttatggaaatttaaaatgtgttaaaaagtatagtatatatacttctattcatgtagtatatatatttcatagtatatagaatatacttaaaaattgtgtacctgttaccaagctttaataaagcttaacgccttgctctatttgctttggattttttaaaaagaaagtaaacatcacagatagagttgattttttttgtgtctttttttagatagagccaccaaactgtattttgttttgtccttattatgctaatgttatttgtttgcaatatatataataatcaatatttattgagtactttatatatgtcaaacagttataagtacctttaatttgttagctcacttaatcatccataaaaattaatactataccacattatttaaaatatataaaaattacatactctgtgaatcctacaaattgcttttatgtgcaacatatttgagatttatcaatgctaatatatgcagccatagtgcatttattttagttatgtagaatatttctacaggtataacatttatttccccattctccttttgatgcacatctaagttgtacttaatttttcaaaataatatataattctggaattaaaatccttacacatttctacttgaactggaagttctttgagatatacaagtagaagtggaattgtagatttattagatttttccaaattacactgcaaatatttatattaatttatgctccatcatggtatacaataattttcttccacttcctcaccaacattttatgtttttagtctctttaatatttgccaatctgatggttttgaaatactatcttgtttttacttgcattttctttatgactaattgaaacaatatcattttacatatttattgtgtatttaagtttctcttctttgaattgttgctcttattctttgtctttttcttattttgtagtttgtctttttcatattgttggcattttcttattgatttatactagttttaatgtaataaattctggatattaattttttgttcattattgatacagcaaatatcttctcatagtctatgacttggctcttgatctttgttaaaaatgacatttatacattcttctctttgctacatggcacctaccctaaactcgaatatcaaccacataattggatataaaacaatcctcagcaaatgcaaaagaactgaaatcataacaaacacactcttggaccatgtgaaaatagcagtcaggacaaagaaaattgctcaagaaattaaataacgtgctctggaatgacttttggataaataatgaaattaagggagaaatcaagaagttctttgaaaataatgagaacaaagctaaaacataccagaatctctgggatatagctaaggcagtgttaagagggaaattcaaagggctaaatgcccacatcaaaaagttagaaagatctcaaattaacaacataacatcacaactgaaataattagagaagcaagaacaaatcaaccccaaagttagcagaagacaagaaataaccgaaattagagctgaactgaaggaaatcaagacgcacacaaaaaaaaaacatttaaaagataaacaaatctaggagttggttttttgaaaatattaataagatatgttgcaagctagacttatttttgcagttgaaagtaatggcaaaaactgcaattacttttgctccaatgtaatagcgtgccaaccaacaacaacaacaacaacaacaacaacaacaacaacaagcataggtcctgatgaattcacagatgaattcaaccaagtgtacaaagaagagctggtactattcctacggaaactattccaaaaagttgaggagaagggacccctccccatattattctatgatactcatatggacaggaggcagggaaacactgggtagaagagggcagtccctgggagggccccaccctcaagcctggaacagtagcccaaagggagaaatttctatcaccatatttctgctcgaatgttgccttttccaaaatcgccctggcccaccccactcccctgattctgtacccataaaaaccacaggctccactggcagaggtgctgcagaaaaggagagaagagaagaagcagccagacattggagagaagcagcttgacttcagagggatggcttgacggggaatatcagaggagagcttggctggggagagcaagactccggggaaagaccaccttctcacctcatattctttccacctccccttcccactgcaagccactttcattggcaataaaatcctccatattcaccaccctccaatttgttcatgcaacctgattcttcctggatgctgaacaagagctcaggagccatgggtatggacacttgagctatttaacacttaagccttccgtggatggcaaagctaagaagacactgtaacacatgccctctggggcttcaggggttgtgggtaccccccagacactgccatggggctgcacagagttttgcttctgccggcacccagaagcattcatcccagttgctgcacctgctcacttgcatgctcctcctcccacaaggggttatttaagagctgtgggctgagtaagtgaggcaccccttttgtgagacccatgaagggtcagggaaaatgttctgtttcaatgccagcatcatcctcataccaaaacctggcagagacacaacaaaaaaagaaaacttcaggccaatatcttggatgaacatagatgcaaaaatccccaacaaaatacttgcagaccaaatccagcagcacatcaaaaagctaatacaccacaatcaagtaagtaagtaggcttcatccccaggatgcaagattggtttgacacaagcaaatcaataaatgtgattcatcacaaaaacagaactaaagacagaaacaacatgattatctcaataggtgcagaaaaggctttctataattaaaaactataacttaggtattaaaggaacatacctcaaaataataagagccatatatgacaaacccacagccaataacatactgaacagacaatacctggaatcattccccttgaaaactggcacaagacaaggatgccctctctcaccagtcttattcaacatagtattagaagtcctagccagagcaatcaggcaagagaaagaaataaagagcatccaaataggaagagaggaagtcaaactatccctctttccagaagacatgatcctatatgtagaaaatcctatagtctgagtccaaaggctccttcaacttttaaacagcttcagcaaagttgtcagatacaaaatcactgtacaaaagttactagtgttcctatgcaccaacaatagccaagctgaaagccaaatcagaaaggcaatcccattcacaattgctacaaaaagaataaaataccttagaatacagctaaccagggaggtgaaagatctctataatgagaattacaaaccactgctcaaagagaagacacagacaaatggaaaaacatccagactcatggataggaactgtcagtatcattaaaattgctatactgcccaaagcaatttacagattcaatgctattcccataaaactaccagcagcattcttcacagaactagaacaaaactattttaaacttcatatggaacccaaatagagcctgaatagccaaggcaatttgaagcaaaaagaataaagctggaggcttcacgttacccagcttcaaactatattacagggctacagtaaccaaaacagcatgatactggtacaaaaacaggcacatagaccaatggaacaaagtggagagccaggaattaggctacacacctataaccatctgatcttcaataaagctcacaaaaacaagcaatgaagactcccttttcaatcagtggtgctgggataactggctatccatatgcagaagattgaagctggaccccttccttacaccatatacaaaagttaactcaagatggattaaaaacttaaatgtaaaacacaaaactataaaaatcctggaagacaaactaggcaatgccatcctggacaaaggaactggcaaagatttcatgacaaagacaccaaaagcaattgcaacaaaagcaaaaattgacaagttggatctaattaaagagcttctgcacaacaaagaaactatcaacagaaactatcaactatcctgtagaatgggagaaaatatttgcaaactatgcgtctatcaaagatctaatatccagcatatatatggaacttaaattttcaagaaagaaacaagcaacctcattaaaaagtgggcaaaggacatgaacagaaactttcaaaaaaagacatacatgtggccaagaagcatatgaaacaaagctcagtatcgttgattgtagagaaatgcaaatcaaaaccacattgagataccatctcatgccagtcagaatggatattattaaaaagtaaaaaaataacagatgctggtgaggttgtggagaaaagggagcactcatacactgttggtgggagtgtaaattagttcacccattgtggaaagcagtatggcaattcctcaaagagccaaaagcagaactaccattcaacccagcattcccattacttggaatatacccagaggagtataaatcattctaccataaagacacgtgcacacaaatgtccactgcagcactgttcacaatagcaaaaacatggaatcaacccaaatgcccatcagtgacagatcagataaagaaaatgtggtatgcataaaccatggaatactatgtagccataaaaaatgagatcatatattttgtgggaatatggatagggctagagactattatccttagcaaaccaatgcaggtacagaaaaccaaatactgcatgttctcacttacaagtggtagctaaatgatgagaactaaagaacacaaagaaggatacaacagacacgggggtctacttgagtgtggagaatgggaagcgggagagacagctattggatactgggtttaatacctgggtgatgaaaaaatctgtatgacaaatccctgtgacctaagtttacctatgtaataaatcttcacatatacttctgaacctaaaattaaagttttttaaaatcaatatttattgtggaggggttttcaactttattaattttttcctttatgattgagatcttaatgacatgcttttttaaggtcataacagatgctctcttgtatttttgaaaagctataaagttttgcttttaatatttaggtctttaattagctgaaattgatttttatgtttgatataggatataaatccatactgtagtttttcttttttattgtttgttcctgtgccatttattgcagtctccctttcaccacagatttttctaaagtactttattgagatacaattggcatagaaaaactgtacacaataaatatccacaatttgataaattaggaaataattatacatctatgaaaccatcagcacaatcaagactataaatatatccatccaacaccttaagttatttaattaattttcttaaaacttaatataagacctaacttgttagcaaattttaaaaatatacaatacagtattgttaactataagtactatcctgtatagtagatcatcagagcttaatcattttgcataactgaagctttgtaccctttgagtaacccttccccttttctttctccctatcccagcacctggtaaccacctttctattctctgcatgtatgaatttgattattttagatttcttataaatgtgggataatacaatatttgttcttctggtcaggcttatttcacttagcatcatgttctccaggtctatctatgttgttgcaaatggcagaatttccatcctttttaatgctgaacaatatttaattgtatgtatatactacagtttctttatctgtcatctgtcaacaaacactaaggttgcttccatgtcttgtctattgagaataatgctataaggaacatagaagtctagatatcactttgagatcctgagtttagtttcttttgatctgtatatacctaaaagtgggattgctggaacagatggtagttctatttttaattttttgagaagacaccgtactgtttttcataatggcagcaccaatttgcattcccataaacagtatacaagagttttttagagaaatgtctattcagtctctttgcccagttttaattgggttgtttacctgatatatagttgtttgatttccttttatgttttggatatttaccccttgtccaatgtatgatttgcaaatattttctctcattttgtaccattttcttttgttgattgttgcctttgctgtttgatgtaatttcaactttttagtttgatgtaatttcagttgtcaatgtttgcttttgttgcctgtgcttttggtagtatgttcaagaaatcattgtgtactatgcagccataaaaaatgatgagttcatgtcctttgtagggacatggatgaaattggaaatcatcattctcagtaaactatcgcgaggacaaaaaaccaaacactgcatgttctcactcataggtgggaattgaacaatgagaacacatggacacaggaaggggaacatcacactctggggactgttgtggggttgggggaggggggagggatagcattaggagatatacctaatgctaaatgatgagttaatgggtgcagcacaccagcatggcacatgtatacatatgtaactaacctgcacattgtgcacatgtaccctaaaacttaaagtataataataataaaaaagaaaaaaaaagaaatccattgtgaagttctctgttgataagcatttcttctgtttccttataagagtttgatggtttcaggttttacatgtaagtctttaatccactttgaattgatttctgtgtatggtataagggtctaatttcattctttttcatgtgaatatgcagttttcccaacaccatttaatgaagagactatcccttccccattgtgttcttggcatccttgttgaagatcagttaactctacatgcatgggtttatttctgggttctttaccccgttacatttatctatatatcttttttcatgccagtaccaaactattttgattattatagccttgtaatatattttgaaatcaggggtatgatacctccagccttttttcttcttggtcagaatcgttttgactatttgggttatttggtggttccatatgaattttaggagttttttctttctatttatgtaaaaaaaggcactgagattttgacaggatttgcaatgaatctgtagatcacttttagtagcatggacattttaaccatattaatttttccaatccatgaatatgggatgtcatattatttatttgtgtttaatttcttttgtcaatgttttatagtttttaatgttcaagtctttattctctttggttaagtttatttataagtattttatttcttttgatgccattgtaagaatgttttctttaatttctttttcagatagttcattgctagtgtatagcaatgcaacagatttttgtatgttgattttgtatcctgcaacactgttgaatttatttgttctaacagatttttgtgtttgtgtgtgtgtatgtgtggagcctttagtattttatctacataatatatcatcagcaaacagagattactttttctttctgatttagataccttttctttttcttgcctaattgctctggaccttacttccaatactgtcttgaatagaaatggtgagagtggacatcccttccttgttctggaacatagaaggaatacttacagctttttatcattgcatatggtattagctgtgggctattcacatatgatctctgttgtgttaattttctcctatacctagttgttcagtattttttatcatgaaagggtgttgaactttgccagatgtttttctgcatctattgatgataacataatttttatccttcattctgttaatgtagtgtatcacatttattgatttgtatatgttgaaccatccttgtatctcagagataaagcctacttgatcatggggtgtggtccttttaatgtgttgttgaacttggcttggtagaccaatggaacagaacagaggcctcagaaataataccacacgtctacaaccatctgatctttgacaaacctgacagaaacaagcaatgaggaaaggattccctatgtaataaatggtgttggggaaactggctagccatatgcagaaaactgaaactggaccccttccttacaccttatgcaaaaattaactcaagaaggattaaatatttaaagtaagacctataaccataaaatccctagaagaaaacctaggcaataccattcaggacataggcatgggcaacgagttcatgactaaaacaccaaaagcaattgcaacaaaagccaaaattgactaatgggatctaattaaaccaaagagcttctgcacagcaaaagaaactatcaccagagtgaacaggcagcctacagaatgggagaaaatttttgcaatctatccatctgacaaagggctaatatccagaatctacaaggaatttaaacaaatttacaagaaaaaatcaaacaaccccatcaaaaagtgggcaaaggatatgaacagacacttctcacagaagatgtttctgtggccaacaaaaatatgaaaaaaagctcatcatcactggtgattagagaaatgcaaatcaaaaccacaatgagacaccatctcacaccagttagaatgatgatcattaaaaagtcaggaaacaacagatgctggagaggatgtggagaaataggaatgcttttgcattgttggtgggagtgtaaattagttcaaccattgtgaaagacagtgtggcaattcctcaaggatctaaatctagaaataccatttgacctagcaatcccattactgggtatataacctcaaaagtataaatcatactactataaagacacatgcacacatgtgtttattgcagcattattcacaatagcaaaggcttggaaccaacccaaattcccattatgttagactggacaaagaagatgtggcacatatacaccatggaatattatgcagccataataaagaatgagttcatgccctttgcaggtacatggatgaagctggaaaccatcattcttagcaaactaacacaagaacagaaaaccaaacaccgcatgttctcactcataagtgggagttgaacaatgagaacatatgggcacagggaggggaacatcacacaccagggcctgtcatggggtgacgggtaaggtgaagaatagcgttaggagaaatacctaatacagatgacaggttgatggatgcagcaaactaccatggcacatgtatacctatgttacaaacctgcacattctgtacatgtatcccagaacttaaagtataataataaaaaaataaatttttgaatagtaatatatgtaatactctctaatgaatatattctcaacttcgttgccctgtctttacttcatcctctatccacagacaaaactctaatacagtatcaactaatttctaagctttttttgaacactctgctgtagaaaaacatacgaatatactgatcagtctcacttcagatgcatgctcaccaatctcatactgtttcagcttcttcattcctgtagttcagcaagtgggagggagtggcatccagtggcttttttgctcccgttgttcggtgagcaggaaggaatggtgtgcaatgacttttttgctcccattgttcagcaagtggaatgaagtgttacagctcttttgttcctaccatctgcagcttggtgaatgggagggttacaggtcttttgtttccaccacccacagcttagtgagttctgagttcttttctcgtgaccatgaggaataaggtacgtggacaccggagagtgagtaaggcagaaaataattttgttgagcaacagaaggaaagctctcaagctctcagtggagagagggaccctgaaagtgggtagccctctgtgaggctgagtctggggtttttatgggcttaaaatgggggcaggctggtacttgctaattggtccataggtggtcttggaaaaagcagcattcaattagttaaaaggcatcatacaccaggaaccaatcgagagagtgggtgggttggcgatagaagttctcactctggttgtggactctatccagaactggcagttcaatttttcaggctttaggctgtctttggcttgaaggttggctttcaccggggacctgtccctgtccacctaggaatttgtctgtctcctgtcactacaaatactatatttcctcagtctatttactttccctctttttaatgactattttagatcttttctctgcccgcacatttcccaacccctcatcctccattctctttctcagctgatggcctttctgattttattgagaaaatggaagcaatataaagggagcttccaaatgatcccgccaccacatgtccctccctgctctctgttcagtatgatctcctccctgcatgttgtgtatattcagtctttatgtttttttcacaagatctcatcaccttttacctacctcagggaatagttccaaattcctcctccctctcctctctttgcaatttttccttttctaataatttttttccaattggcataaaatgtgttatttccccaatctaaaactgaagttttcttatgtgtcttgatcatacttattcttcatgctaatttttcatttctctgtatttatcaataaagcaataaattatttgaattgatttatagtcaatcatgttgtaatttctttataccataatagagtagttcattaatgcagcataaaaatttattttcaagttatgtacatttatggataaactagagacatgttttaaattttaaagttttatatcctgtaccctacttagctaagaagttcagagcatatttcagcattaagttacatgtttaagtgccaggtaaattttccattcataaccaaacacaccatcatgatttttgaaattctgaggagaaatatatctcctagttaagtggaaaattgtgcagttggtttctggagtactttcattctaagcagctttaaaaggaaacattttgtgtagaagtctaaattttctttctttatagtagtgcacattcattcattggtattcttattagacacttgaattgattaatactcctactaattttgttctagatctcagctttgtatttttagcctgattgacattaggattgatcattaccatacacaagatacttcatactgatctagtattttcaactctattaaatataagaagagagaaaatcatgcttgaatgcctggccaagaatgtggttgggcatatttgtggcagatgctggagtccatatagacagaaaaatgtctgtaggtctggggcattacagcctttactcaggactgtccagggtctgaagtctcccagttcctacctccaaaagggcatttatttcctggcttattaatgcttagttgcagtcttgaaaaaagaaagatgcttgagcagacaaatttgtggaaatagttttgaagtgcttgcttttccttcgtgatatttttttcttcattctaaatagatattctctttctcaagactgcagccctactttttgttgtgggaagtcagggaccccaaatggagggaccggctgaagccatggcagaagaatatggattgtgaagatttaatggacatttattagttccccaaattaatacttttgtaatttcttatgcctgtctttactgcaatctctaaacataaattgtaaagatttcatggacacttatcacttccccagtcaatacccttgtgatttcctatgcttgtctttgctttaatctcttaatcctgtcagctgagaaggatgtgtatcatctcaggaccctgtaataattgcgttaactacacaaattgtacagcatgtgtgtttgagcaatatgaaatgtgggcaccctgaaaaaagaacagaataacagcaattgttcagggaatacgagagataaccttaaactctgaccgctagttagccgggcagaacagagccatatttctcttctttcaaaagcaaatgggagaaatatcactgaattctttttctcagcatggaaagtccctgagaaagagaatgcgcacctaggggtaggtctctgaactggccctcctggggcgtacctgtctcttatggttgagattgcagaggtgaaataaactccagtctcccatagcgctcccaggcttattaggaagaggaaattcccacctaataaattttggtcagactggttgatctcaccctgtctcctgataagatgttatcaatgacagtggtgcccaaaacttcattagcaattttaatttcgccttggtcctgtggtcctgtgatctcgccctgcctccacttgccttgtgatattctattacgctgttaagtacttgatgtctgtcacccacacctattcgtatactccctccccttttgaaactccctaataaaaacttgctggtttttgtggctcatggggcatcacggatcctaccaacgtgtgatgtctcccccagacacccagctttaaaatttctctcttttgtactctgtccctttatttctcaagccagccgacgcttaggaaaatagaaaagaacctaagtgattatcggggcaggtcccctgataacttttgaatctcactcagctgcatttgtccaaggtgatcactactcagtcttttaaacattgtatttacttgatgtctatagcactaaattctgggtttctttttctctcctgagtagccatttctcagtctcctttgccagtttctcttcaggctctgattatttaacattggtctgcctcagggctaatctcttggacctcttgtctatctacgaagacaatttcctgccttcctggctttcaatcctatgtaatttctgataacttacaaattgttatctactacgcatgctcctgagcttgacttaacatctggctattcaataaatttctctaacttaatatctttaaaattaagctcctaattatttccccaagttccatcgcagtcaaacctattctccatttaagttaatggtgatttttgcttggtcttaggaaaaaattaaaaaaaaaaataaaactttgcctttctttcttaaaaaggctgcattcttttatagctaatcctgtttgctgtaccttcaaaatacattccctgtatttgaccacttcctgtggccttcactgctgttaccctggcctccattacctccttgcctgtattactggcacaggctttacgagaatcacagttaaggcttgcttttgctttgaggtttctgtacttgtcctctctgcctggaatatttttttctggtaaactccatggcttattctcttactagctcaattctctaaatgtttcttctgaaagctggaagcatactcctacctaacagtatctccctcctcttcactggtttattcttctccaaaagactgatgttcattcagtagagtattacttgcaagaggacagaaatttttatttttttattgtatctctagggcctagaacactggcacattgaattttcctctgcaattttttggcagtcagatgaaaattggaactatgacctactgcataattctcattatcagatataaggatacctataaattcttatacaaaatattgccttacactaaattatacaataaatatataggttgaatcttataaagtatacaagtaagcatacgaataatgccttaatagttttaaaaataaattcagttaatgtaatttaatctgtatgttctatattaataatttttaatggttaagggtataatatgaaaggtatgtatccaaaagacagaagtaatctatatttatttaaaataattggaaataatttttataaaagtagcagtttaatgttattagcaatacatcaccttcatgtaatatgcatagccactcatgacttatgacatttaaatgtttcaccttggttccagcattatgtatggacaaaattaaaaatatcttttcccagaattccttgtatcattgtgaataaaggtcatatctgtaaaatgatgtttatcatagaatcattttaaaattactaaaagtagaagtgaacacaatggaaaaacaaataaatacattatatgagaaatattatttagctatcaaacttcatgttttcaaagaattttgagtttgtgaaagttacaaagttttatgaaaatgtctatctttacagctacagaattctaactggaataaaatgcaccaaaatgttaactgtatttccttctagttataaaattatagataatttttattttattcacttacttttgtatagtttccagaatgtctataatgttttaactttgtaatagcatcagaaataataaataaaatttttaaggaattagtacttcttccataactatgttttgctttttgttgattgaggacaaagatttgtattttgttatacttaaatataccactagtatttaacaataatcatttttaatatcagtgtacaatatattgtaacctaaattttgctttttagacagtttttaaagtacatatcaggattgtactttttttcctccctacagacagccttttgattgattatcaatttaccttcagcttattacaggaagatgatcgccaccatactgccataaactttatagcaaacccagaacaggtgaggaaaaattgttatcttttaaagtataattattggacacaatttttttttcatatttcatttgattttacctcttctcagaattatcacattgtagggcctttgtagaaactactaatcctattaattttttctctcttcgtgattcaataatttgtgaatttgatatttcagattttgcaaatagccctatattttaaattaaatataatttgtcaccttatatatcttgtgacaaaatttatgcctataattatacaagcacggactgttcttatttaaaaataaaactcgttcgggcgcagtggctcatgcctgtaatcccagcactttgggaggccaaggcgggcagatcatgatgcccagagatcgagaccatcctggccaatgtggtgaatccccatctctactaaaaatacaaaaattagctaggcatgatggtgcgcgcctatagtcccagctactgaggaggctgaggcaggagatttgcttgaacccaggaggtggaggttgcagtgagccgagatcacgccactgcactccagcctggcgacagagtgagactccatctcaaaaaataaataaataaataaaactaatgaattcaaagcatactatattaaatgtattttactttcctttataccattccacagtaatatgatttgtcttttttctcagtcagtagtttatctgagttatatgaatgatggctcctttaatgaaattaccacatcactgatatattgtataagcttttgaagtttaaatatatgaaagattcattgtgaattttaatttcaatccatcaattcaggtaaagactcttaggttgtgtcgaaataacacacatattttgctatccatctgagactttattaatttgaaaatcctgagaatggaaatatcaaccatagggtttattcgggttgaattttagttcttttaaaactaacactcatacatttgaaatgaagttatgttaaatatatatattattattatgaattcatccatattgttaaatgatatgttaaatccatatcatatatttaatggtttttcaagtaggtgaaatgtctaaatatattaatactatgacattttgcaacttctttccttttaacgtagttcactggacttgctgacaactaatataatttcttaaatttttcttttccagtaaaatagcattctgtctcccccatcaccaaaaaaaagaacagttcattttacattttatgttactctttattccctagactttatgaatgactgtattcttggggaatacatttaaagttttgacttttaaataatgattttaaagatattttgtttcaaatacaagccgtccttcactgattatctgtttctacatagatatattaacaatctcagaaactacatttatcaatgtgataaagtttttatacctgcattataattaccattgactttttattgtagtaaaatagacataaaataacatttatttaaataattttaggtatgtaattcaatggcattaagtatatttacagtgtggtgcaatcatcaccatcatccacattttcattatccctaacagaaactctgtgattattaaacaataatgcctcattccacacttctctgcagcccctggtatctttattctactctctgcctgtattaattggcttactctaggtacctcatataaatgtaatcatttgtccttttttatctggcttatttcatttagcatagtgtttccaaggttcatccatgttgtagcatgtatcggaggtcattctttacctttagcttcttgattaatagtaattccaaacctgtggggttctttgaagatctaagaaatttgatgtaagagagatatctgactcaaaatgtgagagtgaataatattcctccacagtattgtccatagtgtcatatacttatgtccagattagccacaattctagtttgcttgtctttttgccattttctccttcaatttccagcaatcccaagtgctttccaatgtcccagctttgttttactttctactatcttgtccagttgaagccaagaaaccagaaaagtgttctgtgaagcttaacgatgcataactgtcatgagaggcatcgctaagaattcttataatatcattttgtgtaaccctctttaattaaagatatattcacctgggaataatctctgaaattattatgtattattggccaaggcttcttattctataagaaaataataataaaaagtagataattatttatacatttcctacattttgaaaaacagatttaattttaactcgctatccatcacttctagccagtgctttcatgtgaacaatttctgaataggtttctgtataacattattttgccaaacttatccatatctaacaaacaatgttctaaatcactgattttatcacttactggaataactacagtgtcactttttcagtacagctttttaaatcctaaatgctttttatatggctttagttatggtaccatataattcagcattgcctaaacttggaattgatagagaatgaactaaaaattcaaaaagagttttataggttttttaaatatcaattggaaattttgtgtgaccttttagcgacaacagttatgctcatattaatctcatccagcataaggtacatgtaattaagagacaatttcaaaagaaaataaagatttaagcctccttaagggtacgctgatttcaccatcctttactttcataaaaaagtgactttttggatccgtttcattaatagtaaaaaaatccactcctcagagcatgtcctttttttgagttcccagtcctctgggtgaagatgaagatgaagaaagagaagaaaaagaatataccctgtcactatacctaataacgataacactacaattataagcactatgggctgaaaccaaagttttttttccagaaattatttcatttaacgctcacaagagcttcttgagggaagtaattacatccccattttagagattagaaaaatgatttttggaaaggaaaagtaatttccccctaatcaatcagtctgtacattaaagacctgaaatttcaatctaaggttatctgactcttcactaattcttttcattgcttcatgaaaatgatttactgtatatgaaactgttattggattcaagtctggttactttattatgatgacataaatcaacatttgctaccagatatctacctttgatatctggattttccttaggactacattgtgtatatttggaagtatattttgtataccacaactgaacaacataatctattgaatagtccctgtctgcatgctgacataaaagtattctgcatttattgctacagtcaaagagttgctcagttatttttctggccttccattgaatttatgcccactctgtgttcacttatatcttaaaagaaataggaaaatctcaatatgtttgacagttttgtggcatgtactgcagaagggttcttaacagcttgtcaatagaattcagtattaattgataatcaatagaaaataagaaggaagttaacttccttcttatattcatgggcatttatgaatatcactatgatgcataatataatagccttctgatttactctatgtatttaaaatccaaggttttatttttctttgactacttcaaattctcagatgctttctccacaatattactatgtactactctaaaaatatgcatgacaatcactcaaccttattataacaaattttattttacatgctctttcaagatgatcattctttttgaaatcttatttgcctcctggaaactgtgacaatatcatttgatggatatggaacactgttaagagttcttcatagagaataagctgttcttccatgtagggaaatcattaagagtagatgttatttggaggtataagattggggcttatacgtctgtcaaatggtatggccatcacacatcatccagcagcctttgctttttatgatgttccttatttctcctgctattcatcagggaaaggccattttccttgtcagttttcccctaagactgttatatcagaaaaggggaatttagttgcttccatatttactttctcctaagagccacttagaaaattgggaatatattttctattggcttacctgctttatcatatttagaaaaatagtaaaacgaaggaattaatatattctctatctctcttactccgtttcactagctagatcttagcagtatagaattttctacaagtctttgtagagaatatttaaaataaagcataatacactcagtatctgaagctaaacttacccattatgactatcattctttgcctttccacaggaacaaatagttgtaaatatacctactttctgcttcttacgtcttggagtaagaaaatcacaaaaaacatttaaagaaatctcttagtcatatttccctgaaattaaatgtaaagagtctgtactccactaatgaatgacaagaagcgggttgaatggcataaaattaaattctcagtgttcctctctataactgtgtaaacaatgtgatctgctgtttttttggagtaggttcatcatttttacctgaaagttttaggttatgttatttttcccactagaaaatatgggtttaataataaaaatgtacacctaagaagaagtcttttaaaaaaataatcttatattgttataaaattgcttgggactaatccaaacctgtttcatttaaacctagcaaaaagaatcaaaatacaaatatcaaatttaaactaagtttagtctacagctaagcaaagagaatccaaataaaaatattaaattacaggagcctctggcttacatacaaaagaccaaattataatagagaagataaatgaggaacttgatatctacctttgaatttattacacattttcttcattaaaatgtataaatggcatctacatatattcagttgaatatttacaaaatctatagagtttaaggaataaaacagacataattaaatcagtagactaaatcatatatatctagtgtaattttcgttttttaaccttaatattttcttttctggtagtcgaacaaaaatctggatatatcaattaatgcatcaaacaactttaatctcaacattacgtggtctgtcggttcaacaggtaaaaaaatgttgatgtcatatctcttttacatgtgttcctatctggaagttgttctaacatgatctactgttaattaaatgtttgaaattttaaaaatgttatatgacaggattattttgctgttactggtaaaaataataagtagaaaaatgaatagagcttcattattttgttaactttctcctttattcaattaaaattagattggtaacaaatattatacactaaattaaatttttaagtggcagtgttataaaatgtgattttaattaagataaattgcttctttaatgactaaagagactgaaatttcaattatttgattcactattaaaactataaatttaattattaaccttaatatttatataaaacaatgaaattcttctgtacatgctgattacagtaaacatctattattgtcaagcttagaaaatataacccctcttgtcagcttcagtgctcagaggagttaaaaaactgatacataatatgtctttcataataaggttaataaatttaaattactgacttaaaaagtatatctgagaagctgttcagatttttatgttgaattatgaaatgtattcttactttaattttagttttacttttattctaaaaattttattggtatctattttctgtatcaaaggtatactgttgcataaatgtgctggaaattgtttcttttttatagaaaatttatggattcttagaaatttatatttgatttctgaaaattaaatcattatgctattttaatatgtagaatattatggatacatagaattcaagaattaagagctcttttgcaattcccaaatttatatattacattcaaaaaatgaaaattcaggcaaataggcattttgttactattagtgccaaacatacagtaaaatgttggcactatgggtttcattaaggaaaaattcgtaataacttgtactgttaatttgatagttatttctgaccagtaagaaaactgtaagggtttaaaaatgtgtctacaaaaatgtctataatacatttctaatcactttagaacaataattttagtatgcaagacatcacgtgttctttcagattcccagaccaaatctcagaaatttttatttatcagatttggagatgaagtcatggaatctgcatttaataaatgtacacaaggtgattatggaataagtggttagttaaaaattcaattacgcagtatactaattctaattatttttactattgattaaggtgaaagtattgctaagattgttggaaatgctttgttctattttattaacttcagtaaatatttattcagcactctatgtgtttaaccaattgagcatttagctcatgttttaaattgtggcctccacccaatttatttaaagcagtgatggttcaatttgtggtaagacaaataaattgattttttcccattttttaattggattgagacacacgaaaatatggtctgatttctttttaaatgctctgtggcattgtaaacagaatgagctcagtttctagagccacatatacctgagttccaactgcttagtagctataaacttggggcaaatgctttaatctttctgaggcttaggttgaaatctgaaaaatggaggtgataatacttctgggatattattggttttaaaaaagaatataaagtctctaagctagtgcctagtacatagcacttaatcagtggtagcatttttaaaaataatttttatactaaatttatttccattatatttatggcaaacttattttccttcattcaaaattataaacagtatattttgataattatttttataagagcaattataaaaaactataatatgcatttttaaattcataaagatatttcctaatattaattatttaaattatttacattttagctggaacaatatctggggaagagacttctatagtttccaagaataatataaaggaatacagagatagtttttcctatgaaaaatttaactttagaagcaatcctaacattacattctatgtgtacgtcagcaacttttcctggcctattaaaatacaggtaagtgttaagagtatttacttctaatgaccataatatcattaagaaaagaatggtgcttttgtccaaagtgatgatatatgtacatttcctgacttgactaatacaaaaacatgcattgacctttgataaataaaggtctgcgaatgtctgtgatgatgaatttctctgtaaaaaccctcatggaaccaacaaactctatacttaaatttttcagtgattattatgtactaagcaatgtagccaactgaaatgttttggttttctgattaattatatactttaactgagggttaaataaatactgttctcatataaccccacttgaaattattttccgtttgagtagtcttatttttactttagcacattctgaaaataatctgatctttcattaaagattttgagttagcagtatttcagttacctctttaagtaattacctctcatcattaatttcctaatctgtactacatgtgtgttttacatttcatttttgttatagttagaggtagtctacttaagacgtcagatttacttctaggaaagaattggaatattctttctatcttatagtcaaggtttgtgttcttaatttatgttttcctgaaagaaaagcctatctattgggatgctgggatttgttcattcctttacaactgattgattagattgaatttacattagttattcgaatagcttatatatatcaatccttgttcatggcttttatgttttaaaatcttttaaagattttcagatcatcccttccctatatattagtaaattatagcatatgctctgtaactagaaatgtttgcaggttttatttatattaatttctatgtgatttgtggaaagaatgagtgatttttaaaatcatatgtttactggaaaaaatttttcttcttatttttaaggttgatgtaacacttaaattatggaaattattcaactgttcaggaaatatgaggataaattactattcagttcacttttgagaattaatttgagaaatttacttcttcattgtatagtgattgatttagatgctggtactgtcagaaaaatgccataaatatttgtttttaaaattttaacattaaggatgtgtaactttatttcctaagattcatagagaaatatttatcaaatttcacttcatttattcaattatgattgaaagggaaaagggttcatctatagcacttagtaattagttattaaaattgatatgattatattttaaattgcttcctatccttatttcttgtttatatacttttgaaaaaaaattacatagttattttagaatgtttttgaatacttaatggttaggaattaactttctaaattgggtttttttgagaacttactcttttggaagcaaaatcaaaatttgtgtaacgaggttgaaatactccactctcaaaataatacagtgtggaaaataattgagatggacaagatacgtaggcctaatttctcctctttattaaactcattatgcctatggaatatgttatattaaagcatggaagtattaatatatgtgtttatttataagactagaataaactttaaattataatattatacaaaacacagtaaaattattttaattatgattttaaatactggcagccatcattgtattccctttcaataagttcataagttttttagattccacctataagtgatatcatgcaatatttgtctttttgtgactgacttgtttatttagcatcatgtccttcagtttcttctatgttgtcacaaatagcaagatttcctgctttttaaaggcttaataatattccattgttatgtgtgtgtatgtacgtatataaatatatacatattatgaatatgaaacatatagatataaatcacgatttctttatgctttcatctatccatggacacagcttgcttctgtatcttggctattggaaataacgttgtaaagaatgtgagagtgcagctgtatctctgagatactgatttcacttgctttgaatatatccccagtggtgggattgctggatcattggtagttttatttttaatttttgggggaatcttcatacggctttacatgatggctataccagtttacattccaccaattgtgtgtaagaatttcccttgctccacatccattctaacacttgttatcttttgtatttttgataatggccatcataacagctatgaggtgatatcttattgtggttttgatttgcatttatttgatgattagcaatgctgagcaccatttcatatacctattggtcatttgtgtgtcttctgtggagaaatgtataatcaggtcctttgcccattgtttccattgagtttttgttttcttgctattgcgtttcatgagttccttacatattttggatattaacttcttattgaatagatcatttgcaaatttattttctattctgtaggttgccttttcagtttgttgattgtttcctttgctgtgccaggaagctttttttagtttgatgcagtcccacttgtttatttttgcttttgttgcctgaacttttggtattatatccaaaaaaatcattgataaagccaatgtcaaggagcttagtccctttattctgtttaggatttttataattacaggtcttatatttacatctttaatccattttgagttgatttttgtgtatggtataaagtaagaatccaatttcatcttctgcatattgatatcccagtgttaccaataccatttattgaagagactgtgtttcctttactatttattcctggcactgagtcaaagatcagttgacgctgtctatgggtttatttctagcctctctattctgctccattggtattagtgtatttttatgccagcaacttcctgttttgattactatagattcataatatagtttgaaatcagtaagtatgatgcctccagctttgttcttcttttataaaatttctttgactatttgcagtcttttgtggttccttttgaatttaaaaatttttttttctatatctgtgaaaaatgtaattggaattttgaaagcaattgtattgactctgtagaacactttgggtagtgtggccatttaaacaatgttaattcttccaatcaatgaacataggatattttccatttattattgatgttttgaatttctttcatcaatgctttataattttcagtgtacaggcctttcatttccttggttaaacttattcttaagtattttattctttttgatgctccagtaaatatgatttgtttacttaacttctgatttggagagttcattgttaatgtatagaattcaactgatttttgtatgttggttttgtatcctgcaacttgactgagttttttattctttttaacagtttattggtggactgtctagggtttcttgtgtatgagaacatgtcatctgcaaacagagacaggttttcttcttcttttccaatttggatgccttttacttttccttgtctaattgctttttctaggactaccagtcctatgttgaatagaagtagtgaaactgggcatttttgtttctttgctaaaattagaggaaaaaccttctgcatcttgccattgtgtaggatgttagctattggcttgttgtatgtgttctttattgtgttgaggtacattccgcttaaacctaatttgttggaagtttttatcatgaaacagtgttaataaactttgtcaaatgctttttcagcatctattgagatgatcatataatttttgtccttcattctgttaatgtggtatatcacattttgattcatgtatgttgaaccatccatgcattcctgggataaatcccacttgatcatgttttatgatacttataatgtgctgttgaatcaaatgtggttggctagcattttgttgaggatatttgcatttacatttatcaaggatgttggcctgtaatttttcttttttttccttatgttccctatggtaagctgtggtacaatagtattcatttttatttatttgttttccctcttactgttgctattatatttattttttaaagaacagaatacagcattattaactatagtcaccatgttgtacaatagaaattttcaacttagtccatctatttaactaaaattttgtgtccttttaccaatgtctctgaaatgccattgattttcttttcttgtagtctccttgcctgacttgggtgtcagggaaatgcttgccttacagcataagttcggaagtgttcactctacttcatctttttggaagagtttgagatggcttggtgttaatgctttaaatgtttgttagaattcaccagtgaagtcatcgattcctgagcttttctttgttggaaagctttttataattgattcaatcaccttagttatttttgatgtgaccaagttttctattttcacatgattcagtcttggaaagatgtatttttctaggaatttattcattcttttctaagttatttaatttgttggcatacaattccccacagtcatttcttatgaccttttggtatctatgatgtcagttgtaatgtctccttatacatttataatttgtttaagtcatgtctcttttttcttggttagtcctgtgcaaggtttgtcaatttttaaaattgttttaaaaaccaactgtttatcttttctattgtttttctattctgtatttcatttatttccaccatgatctttattatttccttccatctgctaactttgggcttcacagtttaacaattctattgccatttattgtaaggtagacctagtagtcatgaagttcttcagcttttgtttgtcagcttttatgtctccttcatttctgaagggcaacattgccaggtaaggtattcttggttggtagtacttttcttttagcactttaaatatatcatctcactcctcacctgtgaggtttctgctgagaaatctgttgatatccttagaagtattctcttatatgtgatgggtcacttttatcttcttctgcaattttctttttgagtttttacgattggattatgatgtgtcctagtgaagtcctttttagattgaatctgtttggtgatgttcagcttcatggatctagacatctgaatctctcataagatttgggaagttttgagccattattttcaagttaatagatgcctcgagtttagggactgttgtgggtgaaatagagcagggatggaagggagatatagaggtttttaaagagtatcaccagggatcttggtggtgttaggactcttcactgtcttgagtctggtggtggatgaatacatttttaaagcatccactaagtaaaatcaagtgttatataaacacaaagtaattatggatagttttcagcaaattttgacaaacaatgaaatttaaatttggtgatacaaacaagaatttctaaaatagccctttttgaataattacaaagtaaacagttcttcaataccctgctatcaaagtatggactgactaaccaaaggcattgacatcacccaggagcgtgtcagaaatgtagaattttagccctgtcgccactgaatgagatcctgctttttacccaaatccccctaggtgataatgtgcacagatgcttgcaagccattgtctaatagaaaaacaacaccaccaaaatcactccatttccttaatttgggaattgtctatagtattttcagttatgtctgtgaagatatgaaattgtttggaatttgaggattggcttaaattatggttcacagcataactcaatgaaatatttagtgttctttttccacttgcatctagattagtagagatatgatgtttttaatgtttttttcattttaatgaattttggagatgattgaaattagttaatatcatagtgaataatccttgtcttgttaaactactattttaattatgcatgaaatgctgctatcatttatatgcattatgtaatgtattttgataattaggcagctaatatgtagcaaaacacctttatacctatcagtttgtcagttatgatgtcagtaatgatgttctagttgttatcaatggaagtaatccagtgtcaatggattgcttcttaatcgttatagtatttaattctctgtggcatatctcacttatttctccatttggaataactgtttcttcaatttctgttgcatttgtctttcccatatttgtggtttcaatcaagttattcattcctctgagcttcaattacccaatctataaaatgaagattactagtggtacttaattatagggttatcatgatgattatgtgagatagttatgtgaaacaaaaccttacctattgcattgtaataattgttctaaattgtaaatagatgatcatcattttctttttcttcatcatcaccgtcaacgtcattggtatttaagagagctttttaatcttcttatcatttacctcacctttttaaaacctttggtgatttcccataatatttaagataaatttattcctttatcttttacttatctatattaggttgattacttctactacaagtcatacaaaaattataactgctcatcataacaaagacaaaatatttagtttaattcactcttgttttacatctttctatgttgagagtttaaatcgttgattttagaacttttcttttttctgatatatactctacagctataaattaacctgtatgcagtgctttgaccacattttacacattttggtatgttgtattttcatttttatttagtccaaaatatttcctgatttttcctgtgatattttctttgatgcataagttattccaaaatgttatttaattcatttcagggatatttcaggtgtctcctttttattaatttccaatttagttttcgctatggtcagagaaaaactatggttttaatcctttttaactttattaaggcttgtttttggcatattttttattttgcagaaaattcatgtgcttaaaaagcaaagtgccttctgctcttgttattcttttaatgtcagttggatatttatttgattcttattcaatgtctgagattattgctgattttctttctactttttctatcaattactgagaatattttggaaatttccagctatttttggtgttgtgtttctttttttaatattgtcagattttcttcttgttttttgaaattgtagtttttgtacatatacatttacataaaaggtccctttactgacccttttatttttatgaaatgttcttttttgtctttattaaatctgcatgccaaactactttcagctctccaaatatctatcctctgtcatttatttcattttgctgcttatttttacattctgtatttttatcttgcaaatgacctttctggccttaaccttttttttaactcttgcttagcttttgtctaattgtgaatataacctccccttatacctaactactagaaattactcttttcttacaactggcatattctttaacttatcacagtttatttatatttattgcttcacttatttatccattattagccctcaaactcctttacagagaaactacatatttttttgtatttttagtacttagctgaggtagctaaaggaatagtttttaaattgagagatgagtaatatatttctctggagaaaggaatgtacagataaaatatgctttcttatactcttaaaaaagttttaacatgcaatatagatagtttatgagtacaataaaagatttctcccttatatttacaaaaatcacatgggtttcttatttaataataacccaaattctttcttctcccaaaatgaaattttatagtaagttgttttgttaattaagattttgtgtaagaaacagaaatcgtgcatgactaacaaacagaagaaaatgtattgttagcataaggtgttgctaacaatatgaaagggaagaataaatcatcaggttttcaataagcagaaagctttcattccaacagttttcagtcatgtgcattagttgacattcttaactgggcatgcctgctatactgaatgaaatctcatgatttctccaacccatcctataaatattcactcaggatctaaaaatcttaagtgaatgagtccaactggcaaatttaggacacctgtctaacttcctcctgacccataatggtgcaagaaaaaaaattgtcctgggaagtagttttttggcttctctgctcgaagatatgggacttggattcacaaccccaataaggaaaaaaatatctgaagaaataattctttgtttggtcaggagatatttggtgatcaaaagtcaacaaatactcgttatcatggataaccttgatagaagcatattaatatctaataagactatccttctgaaatcagcatttccttattctaggaaaataatatgactataaaataatgtaattgttattaaagaaggcttcagttattgtgattcttaaaaatatttaattaatctgctgcaaagtgaattatatgtaacattttcatcaatgccaattctaatgtagatattcttatcttgcttccaggttacaattgcttgctttctcattgtcagtaagcagtaggtattaagaacacgggttctaagtcaaactactacctcaatttgaaattcttaaattacaagtgataggattgagaggaaggttttttgtttgttttttaagtcacagtctttccatttcttcctctgtcaaatgggagatgataatattgcctacctttattagtttttcttgctgtgtagcaaattatcacaagcttatcaggttaaaacaaggaccgtttattattttatactgtctgttggtcaggaatctgggcatgagttaactgccctttgttaaaccctgtactcagggcttcacaaggctgaagttatggtctgttgagctgccgtctcatctgaggcagaaggacttcttccaaggtcactagttgttggcagagttcagtatattgaagttgtaggtcttaggtttttctagttactgttagccaggggctcttcttagcctctagaagatggccgctgttccctgccacatggccctctctacaacatgacactgtgcttcttttaggccagttatacaatctcttttcctttaaatctctttcttcagtctgttataatggagactgataaaattcaataatcataggagtgactattctaccacctttggcatataatgtaacgtaatcaagggagtgaattttccattgtattcacagattccacctatacttaagggaaaggctttaacatatattgtattaaaatattagaaatgtgtatatgtttatcttttgaattagggtaaaaaaatggaaagttatttaaagtatatgaaaatagagtaaagatattgactgaaataatagtattatagttttgtcaaaatagttctttttatatcaaatatattttattacaatttatgttatcaaatatgttttcactcctactatctcctgtcctttcttctgtaaacccattagattttaattttacttttattaatttattctgtaaaacatttttatgtgaattacatgccaatcaagcaattattatggtataaagacttcatgtgggtaaagacagtgataataactgtttatttaaaaggcaggttttatcttttcagtctactagcatcattgttggcaaaattcactggttctattttcctttataattataaagatgtttgaggaatagatatctttgttaaggatttttggtatttacttgttaatactgtaccaaatttttgataactaattagaagttttttcttttactgttcctaaattatatgtgttgtaaaagtttcttgtagtaccatagtcttatatctatgaatggaattctagaaatcgagaaatgttttaaaatgtcaaatgcacaatatacttactagagtaggaaattttaagttggtggctatttgtacagaattaatcagacattaatttagccattgagatcctctgccatttaaacatattatttgattaatttatgtactttggaaagctgttttaatctaatgtaaatcaaacaaaagttttcttcattgtcttcaaactttaatagggtgttttatgttttaggttgccaatctctttagcatttaaatatccttaagatcctttagaaattctagtgactgtgagacatatagcagtgttatgtgataaatattccaataatatagtaattaaacagggaaaaaatctttttgttttgaaatgctgggaatcatgccattgagttcatttgcatgtttgtaatatgagattttattttggtagcacttgttcttcatgatttataatgtcatgcaattaaatcttgataataaaaaatagaaaaaagtactactgtagcggtagtgctaataacttcaaaaaaagtgtattgaacttaagtactttgtattctacaatagtgctgttcatcaacatttatatatcacagtttaaattaaattagattgactctcaattacctgtttctgagcaaactggctttgacaattcactattatatcaatctgcaaagtgatgtcataatttagattagattttttaatgagaatgatgctaggaattattcttcactttgcaattctaatttccattctatactggttaatttccttactagcattggttaagttatacagaacaaaatagaagaagaagtgaatcctagtgctgatgtctatacaattttatcacaaataaattagcattttcaacatagatgagtcatttgaacacacacacacacacacacacacacacaaaacagaaaactactggttaagtagatattaaagaggatgttttaacttatacatatgatttgaaaagtggctatcataaaaatgtgctgatggagttgcccttgtatatatatattttttaaattgacacagaacacttttcgttatttgtggttcttgtcttttaaattgttatatgcttgaagaagttatcatatatattttcaaatacacttttttcttttttaaaaaagtttcaattctttttgtcatttaaccaaccaaggtaacataaattcaaaaggtagtattagaaattgttaattttatcagttaaagatgtattaactatactaattagaaatataaatgtgaatgatataacaaatatgtaagaaacacatatagaggagaatggaagattttctaatagctataaaataatactggctatgataggtacaaatgttctcaaaattctcacaaggaagatatattacatttacactacattgacagaattgagtagtgaaaccagagaccatattgcccacaaagctgaaaatatttactgtctggttctttacagaaaaagttcgttgactttttatgcaaaatgctcttatctaatcccttatccagagctattctttacaaggaataaaattgtttgaattaggtgagatggtataaatgtaaaatctgcttttctaagaaaatttcttatgacaaacattttcaacttttccagtggtaaaataaatttgagtaaagaagatttttcatttctttatattataaatttttataaagtcattaattatattttgaaatctaatgaaactcttctaaaaattttaatgcggttttgttaaatattcataataatcccatagatatttttagatggttgcccttgtaatatagtattcttttataaactaccctggtttttatataacatattgtaaacaattttagttttaatataatattaattaatgtttttaatactataagaattttttcagatcatatacttccatagtctgttactggaaatttggagttatttttgttttaaaaaagagcaaggtgatgaatatctttgtgtgcattcatcttctattttagaaaattatttcttttgcacatatgtccccaaattaaattattgggttaaagtatataaacaaatttatgattgtatattatgcactaggcattattcaaggtattgtatatgatttagtgctgttattcctaacttataaaatatttttatctaaatttttataaatgaacaaaataacttgttgaatttcatacagtaggcaattgaattgagatatgagactggtcaatttgacaccagatcccattctaccactattaactcacacttctttattttactatcattttattagtattaatattaaggctgaacatttttctatttataaaatatttactgagaagaatttataaacaaacatatttataatcttatatttatatctcaggacagcttcctgaggatattttgttttagctctagacacgcttccattttaaacctaaactggaagtgtgtaaaagttagtcatttgaaaaaaatataactatacttgatttgtttgcaattacaattaagtattacctcttggggtttgttaagaacttctacttcagaaattgtttaaaaaatgacttaatttttggcaaaggtattaaagtatgagtactatattttgggtttgatttgtgagctactgatacctttaagaattcatcaatatccataatctcagaaggcagtatatttacaataatggatcaaatgaaatattaatatataatgacttagcatagcaaatatttcagaatctctcaatagataataaaggtatatgtgacttaagattatacttctacttggactcgtgtttcatattgttatataatgttactagaatcactaaataaatattgaattaatgcagaatagaggattacagcaattctttaaatattgccttacaaatgaatattcagcacgcagtgggttctatgtgtaaatctgtaggttgaaatttagaatttttactaatgtctttatttttgtaattgctctacaagagttgcttattcaaatggcaaagtaaacacttatgtaagataatgtaaattgtggtagtttcaaaatttccatgttcttttaacttttatgtaatttgacgagaataaaaatgcttcttttattaatatatttataatactgaatcatatgtttctccttattttgtactttgatgattggataaacaaatataataatttttaattaattatgtagtaatgaatttcttcattaataagcatttattgagttattcactttgagtagtctaataaattacagtaaaaacacatataaaaatagaattaataaagtttgaatcagtcccaagaattagagctttatttaagaatcattatttgttgcttcatataggaagctcagagaattgtaaagtagaatccaaaatttatacaaaagcggactttattctgtactgaatgttgttagtaactaaaatttaggcataaaagaagttagaggtgaaggtcttaaatattctttgttttagcatatacctagatattgaataattcgtttacatattctttgcttaggttcccagttctgtactaaccgtaaggtaagaaagagtaggggataatctgtttgctaatagaagagtatatattttatttgttaagtaaataaaatggtatgttttaacatttctggacagtttttgcttttcctaaaacattttggtcctatcaaattataaatgaaaattattatttgtaattattaatttaccaacccctgtgctaatggaaaaagaaacttattgcatgttgatctcctatggaaagacatctgctcttacaagtcagatatgaaattagttccatcatttatttcatatgccttcataaatcaacaatagtttatataatgaaagaagtcaccagaaacttgtattgcgtaaagaactgttctcaaactttcacgctgggaaaaaaattgtttagaaagagagggcatcttgactgaagctttaagcaaatttaggaaattataatgatgttgtctaataattactagagatatagcaaatatagattttcattgcttatattttatttaattctttcattccttcaactttcagcatacattttattggtcatttgtgcatatacaattttggcttattgccaaatatatttaatataatttgatgtaacaacaaaatataccacatgactatatgtacagacctaatttacaaattgtaactcagttatttctttagatttatcaattttattatacttaattttcataaaatctagatgttagaagaaatcgtgtaattatatgtatatgttgttttaattatttacacatggtactttaaagttaatgcaaatgtgattaaatgtgagtgttatgattccattttacttatgatttttaaagcattttatatgctaggtcaatgtttttgatagagtctacatgaaataaacttattgaaatattcattatttttgcacactctaagaaggaatcaatctcatatttgcccatgtttttagagtttgacatgcttttaggctaattgtttgtgagactgtaagaagcagagagagggccactactcaagtgaaatattcaggaagcatttgtaagaatttgtaagaatacagttgaataaacctacactaggtctctcaaaagcagagtgccttatactccctttcttgggataatggtaataattttgaaatgcaattgaagagactctgtttctgattatctttttttttttcagtaaatgtcaaatcttagatctttttcatatcttttaaaattctaaatctatatctcattgatattaggttatgaagtattctgcaaattaccaaatgctgttattaaatattatgttttttcattttgttttatcatattttgaataatcttccaattcactctctacttacagattatgctattttatattttaattttgagattttatctcaggtcttgtttgtgttcactcttttacagttaaaaaaaccaagaatcagtgtattaatatatatcaaatgcagtggcagaatatttaatttatcttaaataaattaaataggataaggtatcaagttacagtcttcatacttttattatatacagtatactttttaggactgtgtgtatttaaataagtcatacaatttttaagggtcatcttattttcccaatgagtgcttctttaacaccactcattgggcaaatgccttctttgaattcccatagcatcttagcttatatttattcttatagtatttgaacataaactctacacttaatatttgaatatataatatgtgaattgcctgtagttgtcttctgaggaatactacaaatttctctcagagttaaccatattttacagttcaaaaatctttccgtttttagactattcaaataatatgtttgttttagtgctttaaatttgctctatctatgctaattatgtgggggagactaagaagaaatgtaagatgtttattgacctaaagaatttaaattaggtaaaaatcaggagcatgcaatagggagaagattaattatgaaattgagagaaggagttggcaagaatcactatgtgagcgaaaatgagtgtaagctattaatgagccatcacttgatcatggtctgtttttttgtgtggtgttgctagtatttagtaggtgtgcattgatattaataagtgatattgataacttttttcctgtactgtctatgtcagatgtggcatttgtgttataatttcttcataaaaagaattaaaaagtgttccttcatttttattgttttataaaaatatatataacatttaaactacctggtctttgaaaccatagtagaatttccctatgaaacctctggtactggtattttttgtagagtaatttctttataacttcctctatttcatctacagaatcttttccatttaagctacttttttctaaatttatttatttctaattaacagataaaattgtatttataatgtaaacatgatgttttgaggtatatatacattttggaatggttaaatctagctaattaaaatatgcattacctcacatagttgtcatttctgtggtgcaaatgtttaacatccagtctctcaacattttttgagaatacaacatattatcattaaccttagtgaccattctatacaataaatctgttaagtgtattcttcctatgtgactaattttgtatcctttaaccagtgtccctccaaaccccctcctcaatcacccaacgtctttattttttttaagtttataaattattttattgtaagcattgctacaattatttgaatcttctagtgttacacattacaaatgaagatctttctttttttattatactttaatttctggggtacatgtgcagaatgtgcaggtttgttacataggtatacacgtgccatggtggtttgctgcacccatcaacctgttatctacattaggtatttctcgtaacgctatccctaccacagccccccaccccccaataggccctggtttgtgatccccgcccccactcctgtcaatgtgttctcactgttcaactcccacttatgagtgagaacatgcggtgcttggttttctgttcttgtgttgctttcctgagaatgatggtttccagcttcatccatgtccctgcaaaggacatgaactcatcattttttatggctgcatagtattcgatggtgtatatgtgccacattttctttgtccagtctatcattgatgagcatttgggttggttccaagtctttgctattgtgaacagtgccgcaataaacatctgtgtgcatgtgtctctataatagaatgatttataatcctttgggtatatacccagtaatgagattgctgggtcaaatagtatttctagttgcagttccttgaggaatcaccacactgtcttccacaatggttgaactaatttacactcccatcaacagtgtaaaaagtgtccctatttctccacatcctctccagcatctgtcgtttcctgactttttaatgatcaccattctaactgccatgagatggtatctcattgtggttttgatttgcatttctctaatcaccggtgatgatgagctttttttcatatttttgttggccacagaaatgtcttcttttgagaagtgtctgttcatatcctttgcccactttttgatggggttgtttttttcttgtaaatttgtttaaattccttgtagtctggatattagccctttgtcagatggatagagtgcaaaaattttctcccattctgtaggttgcctgttcactctgataatagtttcttttgctgtgcagaagctctttagtttagtttcccatttgtcagttttggcttttgttgcaattgctttttatgttttagtcatgagtctttgcccatgcctatgtcctgaatggtattgcccaggttttcttctagggtttttatggttttaggtcttacatttaagtctttaatctacctttagttaatttttgtataaggtgtaaggaagggatccagtttcagctttctgtatatggctagccagttttcccaataacatttattaaacagggaatccttcccccattgcttgttttttgtcaggtttgtcaaagatcagatggttgtagatgtgtggtattatttctgagtcttctgttctgttccattggtctatatatctgttttggtaccagtaccatgctgttttggtaccatagccttgtagtatagtttgaagtcaggttacgtgatgcctccaactctgttcgttttgcttaggactatctgggatatgcaggctcttttttagtcccatatgaaatttaaagtagtttttttttccagttctgtgaagaaagtcaatggtagattgatggggatagcattgactctataaattactttgagcagtatgtccattatcacaagactgattcttcctatcaatgaccatggaatgtttttccatttgtttgtgtcctgtcttatttccttcagcagtggtttgtagttctccttgaggaggtccttcacatcccttgtaagttgtattcctaggtattttattctctttgtagtaattgtgaatgggagttcattcatgatttgactgttattggtgtataggaatgcttatgttttttgcacattgattttgtattcggacactttgctgaagttgcttgtcagcttaaggagtttttggacggagatgatggggttttctaaatatacaatcatgtcctctgcaaacagagacaatttgacttcctcttttcctatttgaataccctttatttctttctcttgcctgattgccctggccagaacttccaatactatgttgaataggagtgatgagagagggcatccttgtcttgtggctgttttcaaagggattgcttccagtttttgcccattcagtatgatattggctgtgcatttgtcataaatagctcttattattttgagatatgtttcatcctagtttattgagagtttttagtatgaaaggctgttgaattttgttgaaggcctttcctgcatctattgagataatcgtgttttttgtcattggttctgtttatgcgatggactagtttattgatttgcgtatgttgaaccagtcttgcatctcagggatgaagctgacttgattgtggtggataagctttttgatgtgctgctggattcaatttgccggtattttactgaggatttttgcatcgatgttcatcagggatattggcctgaaatttttccttttgctgtgtctctaccaggttttggtgtcaggatgatgctggcctcttaaaatgagttagggaggattccttctttttctattgtttggaatagtttcagaaggaatggtaccagttcctcttggtacctctggtagaattcggctgtgaatccatctggtagtggactttttttggttggtacgctattaatcaatgcctcaatttcagaacttgttattggtctatttagggattcaacttattcctggtttaatcttgggagtgtgtatgtgtccaggaatttatccatttcttctagattttctagtttatttgcatagaagtgtttatagtattttctgatggaagtttgtatttctgtgggatcggtggtgatatcccctttatcattttttattgtatctatttgatccttctctcttttcttcttcttagtctggctggctagcggtctatgtattttgtggatcttttcaaaaaaccagctcctggattcatggattttttgaagggtttttcgtgtctctatctcctttagttctgccctgatcttagttatttcttgtcttctgctcactttttagtttgtttgttcttgcttctctagttcttttacttgtgatgttagggtgtcaattttagatctttcctgctttctgttgtgggcatttagtgctataaatatccctctacacactgctttaaatgtgtcccagagattctggtatgttgtgtctttgttctcattggtttcaaagaccatctttctttctatcttaattttgtcatttacccagtagtcattcaggagcaggtttttcagtttccatgtagttgtgtggttttgagtgagtttcttaatcttgagttctaatttgattgcactgtgtctgagagactgtttcttatgatttccgttcttttgcatttgctgaagagtattttacttacaatcatgtggtcaattttagaattaagtgcaatgtggtgctgagaagaatgtatattctgttgatttggggtggagagttctgtggatgtctattaggtccacttggtccagagctgagttcaaatcctggatatccttgttaattttctgtctccttgatctgtctaatattgacagtggggtgttaaagtctcccattattattgtgtgggagtctaagtctctttgtgggcctctaaggacttgctttatgaatctgggtgctcctgtattgggtgcatatatatttaggatagtcagctcttcttgttgaactgatccctttaccattatgtaatggccttctttgtctcttttgatctttgttggtttaaagtctgttttatcagagactagggttgcaacctctgccccttttttgctttccatttgcttggtaaatatttttccatccctttattttgagcctgtgtgtgtctttgcacatgagatgggtctcctgaatacagcacactgatgggtcttgactctatccaatttgccagtctgtgtcttttaattggggcatttagcccatttacagttaaggttaatattgttacatgtgaatttgatcttgtcattatgatgctagctggttattttgcctgttagttgatgcagtttcttcatagcattgatggtctttgcaatttggtatgtttttgcagtggccggtaccagtcattcctttccatgtttagtgcttccttcaggagctcttgtaaggcaggcctgttggtgacagtctctcagcatttgtttgcctgtaaaggattttattttctccttctcttttgaagcttagtttggctgtatatgaaattctgggttgaaaattcttttctttaagaatgttaaatattagcccccagtctcttctggctcgtagggtgtctgccaacatatccactgttagtctgatgggcttccctttgtgggtaacccgacctttctctctggctgcccttaacatttttttccttcatttgaacattggtgaatctgatgattatgtgtcttggggttcctcttctcgaggagtatctttgtggtgttctctgtatttcctgaatttgaatgttggcctgcattgctaggtcggggcagttctcctggataatatcctgaagaatttttcccagcatggttccattctccttgtcactttctgctataccaatcaaatgtagatttggtcttttctcataatcccttatttcttggaggctttgtttctttttactcttttttctctaatcttgtcttctggctttatttctttgagttgatcttcaatctctgatatcctttcttccccttgattgattcagctattgatagatgtgtatgcctcacgaagttcttgtgctgtgtttttcagctccatcaggtcatttatgtttttctctaaattggttattctagttagcaattcatctaaccttttttcaaggttcttatcttccttgcattgagttatgctcctccatgctcctttagcttggaggaattagttattacccaccttctaaagcctacttctgtcagtttgtcaaactcattctccatccagttttgttcccttgctggtgaggagttgtgatcctttggaggagaagaggtgttctgttttttggaattttcagcctttttgggctggtttctccccatcttcgtgtatttatctacctttggtctttgacgttggtgaccttcagatggggtctctgagtggacatcctttttgttgatgttgatactattcctttctgtttgttagtttttccttctaacagtcaggcccctctgctgcaggtctcctggaatttgctggatgtccactccagactctttttgcctggttatcaccagcggagccagcaaaacagcaaagattgctgcctgttcctttctcagcaagcttcgttccagaggggcacctgccaaatgccagccagagctctcctgtatgaggggtctgtcagcccctactgcaaggtgtctcccagtcatgatacactgggggtcagggacccacttgaggacccacttgaggccgtctgttccttatcagagcttgaacgctctgctgggagatctgctactctcttcagagctgtcaggcagtgatgtttaagtctgctgaagctgcccccacagctgccccttcctgcaggtgctctgtcccagggagatgggggttttatctttaagtccctgacttgggctgctgccttttttttttcagagatgtcctgcacagagtggaggaatctagagaggcagtctggccgcagtagccttgctgagctgcagtgggctcagctctgtttgaacttcccagtggctttgtttacactgtgagggcaaaatcacctactcaagcctcagcagtggtggacgccactccccccaccaagctggagcatcccagttcaacctcagactgctgtgctggcagcgagaatttcaagccagtggatcttagcttgctggggtctgtccgggtaggaccagctgagccagatcacttggctccctggcttcagccccctttccaggagagtgaatggttcttcctggctggcgttccaggtgccactgggatatgaaaaagaactcttgcagctagctcagtgtctgcccaaatggctgcccagttttgtgcttgaaacctagggccctggtggcatagacaccagagggaatctcctggtctgctggttgcgtagactgtgggaaacgcacagtatttggcctggagtgcgctgttcctcctgtctctcatggcttcccttggctaggggagggaaatcctctgacctcttggcttcccaggtaaggcgatgccctatcctgcttcagctcaccctctgtgggctgtacccactgcccaaccagtcccggtgagatgaacggtgtacttcagttggaaatacagacatcactcaccttctgtgtcaatctcgctgggagctgcagcctggagcagttcctatatggccatcttgctagcaaatcgtcaagctctttatttttaacaggatttctgaggtttttgtttagaagtctgcaaagtgatccctcattctattaacttgtattgtttcaatggttatttctttttttggaggtgggcattcgtccttgccttcttgatcattataactgacaatttacttacattgctaatgttttgaaaaattagagtttgatttaattaggtctctcattcttcatattcttgcatcattaatgcttactttcatctttgttatagtatttccttttttggctttctattagtttactttgaggttccttttatcatttctagagctttatatttcatttattttagatattttatgtgtatattttatatttatatttcatttactttatatattatatatattataattcatttcttttaattctttcatttttactaaagtgatttttttttttttttttgagatggggtctcactctgttgcctaggctggagtgtagtggcacaatcttggcccactgcaagctccgcctcccgggttcacaccattctcctgcctcagcctcctgagtatctgggactacaggcgcctgccaccatgccctgctaattttttatatttttagtagagacggggtttcaccatgttagccaggatagtctcagtctcctgaccttgtgatccacccgtctcagcctcccaaagtacagggattacaggcgtgagtcaccgcgcctggccttactaaagtattttttgatggaaatgttcattagcttcattttgtcattcatatgtatatgtaaaacaacatcactttgtactccataaatatatagaattataacttgacaatttacaataaaataaaaaataatctttttttttgctttgtgaaattgttatttatttcttatcaacttttattttagatttagtggtagacatgccagtttgctacatgggtaaactgtgttttgtggggatgtggtgtacagattatttcattgcccaggtaatgagcatagtacacaataggtagttttcaatcctcaccctcctcttactctccatcctcagataggcccttgtgtatattgttcccttcttcatgtctatgtgtactctatgtttagcaccttctcataagtgagaacatgcaatatttggttttctgctcctgcattatttcgcttaggatattgaccttcagctccattcatgttgctacagaggacatgattttgttctttttatggctgtatagtattctatagtgtatacgtaccactttttctttatccagcccaccactgatgaccatctaggtttattatgtgtcttttctattgtgaatactgctgtgataaacatacacatgcatgtttctttatggtagaacgatttatattcctttgggtacatacccaataatgggattgctgggttgaatggtagttctgtttaatgttctttgagaaattgccaaactgctttccacactggccaaacaaatttacatttccaccaacactgtataagttttctcttttctctgcaaccttactagcttctgttattatttgactttttaatagtagatattctgactagtgtgaaatggtattattgtagctttgatttgcaattctttaataattagtgatgtttagcatttttttcttatgcttcttggccacatgtatatcttcttttgaaatgtgtcagtttgtgttctttgcccacattttaatggggttatgttttttttggttgttaatttttaagttccttataaattctggttataaatccttagaccattgttggatgcatagtttgcaaatattttctcttattctataggctgcttaatatgctgatagtttcttttgttggaagctcttcagtttaatttttgtcaaaaattttgtcaatttttgtttttgttgcaattgcttttggcatcttcatcatgattttgtatcctgaaactttgctgatgttgtttatcagatctaggagcttttggtcagacactatgaggttttctacatatacaatcatataatttgtgaagagagatagtttgacttcctctcatcctgtttggatgcatttcattcctttctcttgcctgattgctgtggccaggacttccagtactgtgtcgaacaggagtggtgagagtaggcatccttgttttgtcccagttctccaggggaatgctgctattaatagcttttgcccattcagcatgacgttggctgtgggtttgtccttgatggctcttgttatttcaaggtatgttccttcaatgcctagtttgttgaaggtgttaacatgaaggaatgtttggtttaattgaaagctttttcttcatatattcagatgattatgtggtttttgtttttagctctgtttatgtgataaatcacatttattgatctaggtatgttgaaccaaccttgcatcccaaagataaagcctacttaattgtggtggattggatttttgatatgctgctcaattcactttgctagtatttttttgagaattcttgcatcaatgttcatcaaggatattagcctgaagtttccttttttcattgtgtctttgccagattttggtttcagaatgacactggccttgtagaatgagttagagaggagtccctccttctaaaattttggaatggtttcagtaggaatggtgccagctctttatacaaatgatatattttgtctgtgaatctgtctggtcttgggttttttctggtaggtagactttttatttctgattccattttggaactcattatttgtctgttcagcaatcaatttcttcctcgttcaatcttgggtcgttgtatgtttcaaggaatttatttcttctaggttttctagtttgtgtatatagaggtgttcatagtagtctctgtgggtgttttgtatttctgtgggaatggttgtagtgttatgtttgtcatttatgattgtatttatttggatcttttttctttagtagtatagctagtggtctatgagtcttatttatatttcaaagaatgaagtgggtttgttaattttttgtatgattttgtgtctcactatccttcagttgagttctgattttggttacttcttatcttctgctagctttgggttttgtatgcccttgtatatctagttcctctaggtgtgatgttaggttgttaatttgagatcattctaactttttgatgtggacgtttagcactaaaaactttcctcttaacactgctttaactgtgctccagagattctggtgttttgcatctttgttctcattaatttcaaagaattttctgatttctgacttaatatcattgattaccccgaagtcattcaggagtaggctgtttaacttccatgtgattttatagtttcgagtgatcttctaagtattgatttttatttttattgcactactgtctgagaatgcagttggtatgatttcagttttttttttttaatttgctgagaattgttttatggccagttgtgtggtcaatatcagagtatgtgctatttgcagatgagaagaatatattcttttgtttttgagtggagagttctgtagatgtatgttaggtccacttgatcaaatgtcgagttcaggttcggaatatttttgttagttttctgccttgatgatctgtctaatattgccattgggatgttgacatcacccactattattgtgtggttatgtacatctgtttatatgtctctaagaacttgttttatgaattgggtatttttgtgttgggtgcatatctatttaggatagttagttgttctttaattgtaaccactaccattgtataatacccatctttgtcttttttgatcattactggcttagtgtttgttttgtctgcaactataatagcaacccttgctgttttctgtttttcatttgctcggtaggtttttctccatccttttactttgagcctatgggtgtcattgcacgtaagatgggtcagcatgtaagctggttattatgcagacttgtttgtgcagtttctttatagtttcagttatctatgtacttaagtgtctttttgtggtggaaagtaatggtcttttttctccagatttagcactccttaaggatcttttataaggcaggtaatgaattccgttatttgcttgtgtgaaaagtatcttattttcccttcacttatgaagcttatgaaggaatatttggtttaattgaaagctttttctctatatattcagatgattatgtggtttttgtttttagctctgtttatgtgataaatcacatttattgctagatttttctccatccttttactttgagcctattggtgtgatgtgaggttgttaatttgagatcattctaacttttcgatgtggacgtttagcactataaactttcctcttaagtttggttggaaatgaagtttttgatttgagtttttattctttaaaattgctgagtatcagctcccagtctgttctggcttataaggcctctgctcaaaggtccactgttagcctgatggggttccctttgtagatgacctgccccttctctctagctccatttaacattttttctttcatttctaccttggagaatatgttgactatagtcttagggatggtcttcttgtgaggtatctcttggggttccctgcatttcctgaagttgaatgtggcctctctagcaaggctaggggagaaagttgctggctttctctccctgtctttcagcgacaccagtgagttgtagatttggtttctttacataatcccatatttctcagaggatttgttcatttttttaattctttaaaaaacattttttttctgattgagtttgtttggagaaccagtctaaaagctctaagatgtgttcctcagcgtggtccattctactgtgaatacttgtgcttgcattatgaaatttttgtagtgtgttttgcaactctatcagatcagtttggttctttcttataacggccattttatctatcggctcctgcattattttattgaaatccgtaaattctatggatgggtttcatctttctcctgaatctcctgaatctttatgatcttcataggggatctaagtgcagagtgcaaaaagcctgtggcagatatgtgagtccatggggactatcactcacttatcatttccccatggtggaggacatcccttggctcaatgccacttttgggcgggcaatagttctgtctcactcttttctgttctccatgggtcacattttttccttgatgaatcccaatgtgttcacctagatgttctagttgaagggctagtgttgctcaccactctcttctctccatgaaagtggtgcacactaattggttctaatcagccatcttgtaaagtctcagtgtaagttaagtttactcttttttttcttttttttttgagatggagtcttgctctgttgccatgctggagtgcagtggcgcaatctcggctcaccgcaacctctgactccctggctcaagcaattctcctgcttcagcctcccgagtagctgtgattaggggcatgtgccaccatgtccagctaatttttgtatttttagtagagacggggtttcgccatgttgtccaggatggtgtcgatctcctgacctcatgatccacccgcctaggcctcccgcagtgctgagattacaggcgtgaggcattacacctggcctactgcactttttaaaaatcatcaaagcatgaaattatctatgagtgagtgaaaactcattagaaagagtcttctcaaagaataaattactttatgccattaaattgataccaaatctgaatttgactagtgctcagcaacatcttatttcccacattagatttaatttaaatatagtaattacccatgacttaagaaaataatattttaaataccatagtaaaatatatgtccgatatttattttctttgcctattattattattttgcctaatatactctggtataaaaggccttccaaataccacagggtagaaaagatttttaaagttacaaataaattcctataaactatatatggcattacatgattttcaactttgtttttagctatattggataatcataagatttcattttttaaaaaattgaaaagccatgatctctcaacttgggttttaaaatttatcatgttttgattataatgagtcttaagctctatgatgccatttttttatgtagttaattaatggaaacctatgcttatcagggaaagacatcagcaattgtggggtacctaataaatcacctttgtaagatttttcttctggaaagcacctcactgttactacattctgtttcattagtctaacagtgaaaacagaatagcaactatctcttaaaaattagatactttctatatataagtatatactttaatatacaaaatataaatatggatatcaatattttaaaattttagtcgttttgtttccttaactattaatgtatttttataatgcaaatgttttattactcatttaataggaatatatatgcattaaaaaattaatgttttgggtagtagaacatgctttactcttagactgttggaaatacttgctactttcagcttttagacataacccaaatttctaaagttttaaagataagactgaatgataaagtcaatttagtgcatttcctttacaaaatgagtacctttggttacttaacacagtatgcagaaaaagataggttatgaaaaaattataatttctataaaatggtgttaaaagcaaaaattgctattatgaatctttgatttgtgaattgaaatctgagaatcttcaagaaatctcataaatatgcaaatactataattaaatacaggtatcattataattactaatttttatcttgtcattttaaaggttccgttttgttttctaacatttataacaatatttttttgacaaaaataggttttaacttcaagaaattatactcttcaagaaactaactgaagagattgggctcaattttaatgtagatataaaattctacatattttaactggtataatctttgtgaaaaagtaatgcttgttttctagtacagcttgacctttagctaaaatgaaactattttaagagtttttactttgaacattgagtgtgtgaacaccgaaaagatgagacaggtgtcagttaatttagaaagcttatttgccaaggttgaggacatgcacctgtgacacagcctcagaaggttttgatgacatgtgcccaaggtggttagagcacagtctggttttatacattttagggagacataagacattaacatatgtaagatgaacattgattcagtctggaaaggcaggacagctggaagcaaagatgggaagacttgaaggagggagagggttctaggttataggcagataagagacaaatagttgcattcatttgagtttctgattaacctctccaaaggaggcaatcagatatgcatttatcttagtgagccgagggatgacgttgaatgaactgggaggctggttggccctaagcagttcccagcttgatttttccctgtagcttagtgatttggaggcatcaaggtttattttcctttcacgtttactcctttttccttttaatcatcttttggagaaagcatttcagaagaaaataagtttctggtctcaggttttgtctgatcttttatggctaggatgctttattcctagacaggtaggtcccaagttattaggaaagctcattttttgcaggtgttgaagacttatgtttatgaagagaaaatagggggaggaagggagaaaaacaaccacaaacaaaggaacaatcctggataattgacgtaggccacagtactttgaagtccatccatcagtaggcatgtatgaatgtggcttatgtatgtaaatagattgctgttacattttctgaagtttaagttgtttagctttagtttgcagggcttcacgaaagcacagcttagttttcagtgactccaaattaggaaatatggggaaaaaataaggaaaacaaattgaaaacattagtttgcagatttgtagtcaagaaaaattagaatttggtccaaaccttagaaaataataaaaattgaaaaacattaggcaagactagaatctaacatcaggtgtcctatagtttttgaaatttttttttctccagtttcccgtgtttattaaagacaaatcatggtaggactgatttgttttattatacttgacctcattatttgtatatagtgcagcaagaataattttttttttgaaatggagttttgctcttgttgcccaggctggagtgcaatggtgtgatctcagctcattgcaacctctgcctccggattcaagcaattcccagccccagcctcctgagtagctgggattataggcatgtgccaccacgcctggctaattttgtatttttagtggagatggggtttctccatgttggtcaggctggtctcgaactcccgacctcaggtgatccgcctgcctcggcgtcccagagagctgggattacaggtgtgaaccaccacgcctggcccaaataattattttttttatgtaggcttttaaattggctttgatggaactttgtttcatagcagaaatttcaggtaagactttttttttttttttttttttttttgagatagagtttcgttcttgtcgcccaggctggagtgcaatggtgcgagctccacttactgcaacctctgcctcctggattcaagcaattctccttcctgccttagcctcccaagtagctgagattacaggcacccaccaccatgcctggcttatttttgtattgtttggtagagacagggtttcaccatgtttgccaggctagtcttgaactcctaacctcaggtgatccacctgttttagcctcccaaagtgctgggattacaggcgtgagccactgcgtctggcccaggtgagacttttttaaagctgtgcccagccatggatttgtaccattaaatacctatgagttgggtgaattcctcttctcttgaggtttcaggataaacttggggctcatgggcctattagaaagtgacattattttacttaccacaggttatgaaccctgttacagggactgtagacaaggtataaggccagtttttccatggggctgttattggctccataagttgtttgattccttaaaagaaagtacatcattcctgttaatgctttggtaaaaataacccatttcttcagtcatgtactgttacaaattaaaacagattcttattgcacattccatagttatatggaaataactatattgccataagttaagaatactaacaagtagtttttaaattctgtagaaatcaggtagagagaaacaaatgttgtttataggagtatactaaattattagaagctattaatagctttaaagaaaagttttcttgacattgaaaaaacaaaacaaaggattagcaatgttttaagcaaaaagttaaaaagagtactgtagtcatctattagttcagtccatgcagttaattcctgttctgcttgacatttatgaacatatcagctctccctgtgtcctgaaattttttcctctatttacatatcaaaatcttcaaagttatcagagattgcattcaagagcacctgttagagttttatagctgattataaaacccccttctaaagaggactaaaagaagacaacaattgtccttggattacaaaagttttaagatagccaaagtttaagacacaattaagtaaatttgttatgtctgtggcacacaataatttaacataacaattacaattattactgataatgtatactaagttatatcagaattatgggagttttccataattttggaatacatatcaataatgtatttatacaaatacagctcaaagaaaaccacgtgccattttgtacttgacaatgcttcttgtataatttttataccaattaagccaaattatgttttttttggactctagggaccctaatatcttaaaggattaattaggttagaaaaagacataatttataatttgattttggaaagtttgttaaatatcaaaggtttaaaacacttgatatagcaggttattgtaaaataagttattcattcaaccaaagtgataactcaaggatttttaaaaagaggcaaaaacccttattttttgagagaggagacttaattttacaaacaagaagccctagtaaaaatagcatgaagccaattaatttttttttaattttataaacaatttataaaattttaatcctgaccataggatataacttccataatcctcttataacctttattaaggagtcggttaatgctttaagaaaaccttgttaatctgacacagctgtacatatgctggtattgccttaatgtgcctttgacattaatgattgatttatagataaactgaactgattttatctttaaaaatggccctatagcattaggagaaatatcaaatgtagatgatgggttgatgagtgcagcaaatcaccatggcacgtgtatacctatgtaacaaaactgcatgttctgcatatgttccccagaacttaaagtataattttaaaaaaaggccctaacagtctcacatccccacctcctctgcgatagtttttgggccttgaggagttgaatagctttaatttctggccctgtatgtctcaggaatacagtttattttgactggcatcttttaccgggcctgaagataaggctgtaactgcttttagtgtttatgctttagcaggacttggtgtcctttttagactcaggatttaaaaccatgtaacttaatattacaaggactttaaaagcacatgaagaaggatacacatatgtaataaccttaattaaaaaaattaattttagttattttcctaagcaaaccaaaacttaataataatggcataggaattgtttcgataaactgtaaaatcttttaggccagttaccaaagggaaaagaaaaggccttttgcactgtacacaatattatgatggaagaaaatattttctttagagctttaagaaaatattgttagtctcaggcaataacaaacaggacatgaggaaaaaaaattatatgagctgaaaatgtgttgaaggagaagttttgctattttacacccttaaaaggggagagaaaacctaaaacggtgagatgcaatacaagttgaacattgtgttaaaaacaaattaaaatctcatataatttattgagtaaatcaatcccttaagaaaatttcattgttttaaccaattatgtagtgtatgagtgtttttgtatatatcaagcccagtctttaaaaagaccattacaatttccctttaattatagacaactttattatgtaaaagtttttatttttatttttttaataaattctcttcttgtgacttacccagactgttcatgacatgcttggactttctggtttgtcctgaacatcactttttcttaaacaaccagttattttattataggactaaatctaccctacaagattttttttcatattaaattatttttctttaagcttttttaccaaaaaaccctttttatttttacaacttcctttacatctttcttatttcctggttccttttaccttcttgtaatataacctttaaattagctttgaattagacaaaatttgttcaccttttcaaaaaggacacactttttttcaagaaagaatgtttttatacaaatatattattattggaaaatgcccaaataatgaaatatctattatttaatttaactttagattttaaattataacacttttgtttacaagtatttatcccattacatttacctaattattttctttttatcatttacctagattgtgtatgaaaactgaaatagtcattatttaaagttattgaactgccattgcaaaattgtacctgagacagtaaaaaagatttgatctaactgacttcatcttgattcttgttcattcctcggtattggctgaacaaactaaattaggaggaatttagtttatagtttagctttgaatcaaagatgaagataacattcccttcccaaaacaaaccgtattgcctgtggactagtccacctaaagccacagaattagaagttatggtaatcttactaaatttaagatgtatctatttttattaaactcatgttaatgtcttatttactaaagattatggaagcaaagattattttctcttgggctgggtttaaagtttatagccaaattttgacactgtatagtatttgaaaggaataagtatgaaattacttgaataataaatacaaagaatgtatgctggcaattcttaacacatttttaatattactttaccaataattttaaagctggcttatttattaaagattttacttaagttaaataaacttgaaaaagcatttgactagccttttcttttttcatgataaagtatttgatttaagcacttttattttcttaagccaattagagatcttttatatattttcagtagtgaaacattgtgtacacaacacaaaaatacatagatgtattaggcatgcctatagaagtacatctttagatttatagatttataaagacctttttttctatcttagacttttagattcttaataacatgttttataacccagagcagttttcagctaaatagccttaaatttgcatattaaaggagacaactcaggtgaaaatcaaattacaaaatttacataataaggtactgagacaaaaagtctggtggtgctagagggagattaaagatggatgccaaattaaacataaaattatagaaatctgtcatagaattgtataaggagaccaattttatttagatacagactacatatattttaactggatctttgagctctgggcagagcccacactgaatcctgggtctccaaaaagggagaataatcatgatcttagactagcatggcatccatgcttttacagtgcacttaaaataattctttttaaacaaagatatttctaagtgtttgaactgcatgcttccttaaaacccaaaagtagcctctgttgtaataggtattttagttaaaaaaatcaggttacaaaatacgaaagcaagcagtttatttaagagctgagacaaacttgtctgtatattcttttggtattccataaaaagcaaacaaacaaacaaaaaacagaagttcctccccaaaagggagctaggtaccttctttgatttctttaaggacccccaagatattttaaactattttaggtcccacatgtagtagatggtgcaagagaaaggagagagagtagatgtaaatggagaaaacagaattcagttaactgagaagaaaaaatattttgctcaaaaaaaggcaaggttctaggagagaaaaaaaaacatgaacgccttttaaatacaaacaggcacacaggcacacatacacacacacacgtcttggataatgacttttaattaagcttaaccactgagctcctttaaaaatttttttaaatctcattatcatatttcagctaggagaaattgctgctatttcagaagtaccaagtatcaaaccagaaagggctggattcaggaaccaaacccagggtgtcctggtggaagaaaaaaaaaaaaagaaggcagaaccttagctgttgaactccagcatgggtggacagccattgttctttcagtttggcctggctagtaaaaaggtggccttgttatgtaaataaagcccctttagtagttaaaattaaaaaaaaaattcatttctttttcccttttgctgtccattttctcccccactacaccacctttgtgtgcatgtgttgtggcagggtgtcaggggtggtggtggggaatttagccacttcagaggccttgttccccataatttggaattttccttcaaattttatcaagtctgatagagttggttaaacccaatgggaaaaagactgaaggaacaataaaaataggaacaaacatacaacaacaacaaaaacagttaaacaaacaaacgacagcaaacaaacacattatgtgattactgaatattgtaatggtaaggagaaattaagaccagctggttcttaaacttagccaagacaaaaccccaatttagctacttacctagggatgggtctcaggctgaagaccgtactctaccagcctagaagctggaaaaaaaactaaaaaacaaaaacctgaactcatcttccctgctgcaaatgagctcaaactccataaaggagttatctgcctttcatcatcatggaaacagaaaatcttgccttccttgttggaagcaagtaaaactccaaaaaagggaagttgtacggcaaaataaactttagatctcgaccaaattttgggagatcagggattctctggacggtatgctcccagacctcagcaaattgtcctattggagccataatgtttgcttatgctgatatcaagcaccaataggagatttgtgaaaggtcagaggcatctccagtcagaattgccttgtggttaccaaaatgtgaacccccaaaatctgagacaggtctcagttaatttagaaagtttatttgccaaggttgaggacatgtgcctgtgacacagcctcaggaagttttgatgacatgtgcccaaagtgattagaacacagtttagttttatacattttagggagacatgagacattaattaacatacataagatgaacattggttcagtctggaaagtcaggacagcttgaagcaaagatgggaagacttgaagcagggagggggcttccaggttataggtagataagagacaaatggttgcattcctttgagtttctgattaatttctccaaaggaggaaatcagatatgcatttatcttagtgagcagaggggcgactttgaatgaaatgggaagcaggttggctctaggcagttcccagcttcatttttccctttagcttagtgatttgggggcccccagatttattttcctttctcaagtgttacatctctagtagatactgcaattcaataagtaaaaatgctaggattttttgctagttactaggaatataataatcaaatgcgtgattgcaaatattataaagtcacatgaagaaaaaggacaggtaacctaataatgatagtacacactgtgactaattgttgttaggaaagtgtagtacttaagaactagagtcagaatgcactgattttcatttcagcttcactacttattgactgggtaaccttctaagccttgatttatcatctataaaatgaaattaataacattacctaattgatgaggtaattcggagtattaagtcagttaatgtacgaaaagtaattagcacagtgcctgggaaatagtaagcactttatgaatatcagctctttttagtagtagtattgtagaagtatatgtagagaaatcaggagtaaaatgaggattgccattcacacaaaatccagaactggtaggcaatgattctagaataagagttacccatgggtggaaggtataagggatgagggaaaagtttgtgccaaacagggttacagaggtttgctaatgtatgtcaagtttttgaaactgctggtataggcataccttgttgtattttacttcgcattattgcacttcagagatgttgtagtttttttactaattgaagttttgtggtaaccataggttaagcaagtctgttcgtgcaatttttccaatatcatgtactcactttgtgtctctgcaccacattttggttatttttaaaatatttttatttttaaaattattactatatagattatggcaatttgtgatcagtgctcctcgatgttacttttgtaattgttttggggtgccaaaaactgtacctatataaaacaagtcagcttaattaatgtggtgtttgttctgagtgctccattgactggaagttctgtctccatctccttaggcctccttttcattgagacacagcaatattgaaatcaagctgtttaataatgctacaattgcttcccagtgttcaaatgaaaagaattgttgcatgtcttgtcactttaaatcaaatgctacatgtgattaagcttagtgaggagggcatgttgaatgccaatacggccgaaatctaggcctcttgtccgaagaattagctgaattgtgaatgcaaaggaaaaattcttgaaggaaatgaatgctactttagtgaacacacaaatcataagaaaatgaaatagcctttttaatgatatggagaaagttttagttgtccgaatataagatcaaaaccactataacattcccgtaaacctaagcttaatttagagtagagcctaactttcttcaattctacaaagtctgagagaggtgaggaagatgcagaagaaaatttggaagccagaagaaggtggtttatgaggtttaagtaaggaagccatcttcataacaaaagtgcgaggtgaagcagtaagtgctgatatagaagatacatgtctaacttaattgatgcagtagctacactaaataacagattctcaatgtatatgaaacagctttctaaaagaagataccacctaggaattttatagcaaagaagacatgtaaatgcttgacatcaaaattcaaaagacaggatgactttcttgttaggagctaatgcatctggtgattatgagccttggtaatgagccagtgctcatttacccttctgaaaatcctacggtccttaagaattatgctaaacatgttctgcctatgttctataaatggaacaataaagccagcatgacagcatatctatttacagcatggtttactgaatattttaagcccactgttgaggcctactgcttagaaaaaaaagacttctttcaaaatagtacagctcattcacagtatacctagtcactcaagagctttgaaggtgatgtgtaaggagattaatgctgtttcatgcctgctaacacaataactgatacggtttgggtggtgtccccaccaaaatctcatgttcagttgtaatccccagtgttggaggtgggggcctggtgggaggtgattggatcatggggatggatccctcatgaatggtttagcaccatccccttcatgctgttctcttggtgctgatagtgagtgagttcttgagagatctggttgtttaaaattgtgtagtaccccctcttcactctctcattcctgctcctgtgcctgctccgccttcacctttcaccatgattctaagtttactgaggcttccccagaagccttgcagatgccagcatcatgtttcctgtacaacctgtgggtctatgagccaattaagccccttttctttataaattacctggtcttgggtatttctttatagtaatgcaagaatggtctaagtacaataaccatttggcagcctgtggatcaaggagtaattttgattttttgtactatttttattaaaatacattttgtaaggctatagctgacataggtgatgattcctctgatgaatctaggcaaagaaaaatctctggaaagaattcatcattctaattgcctttgataacattcatgattcatgggagtagatcaagatatcaacattaacttgagtttggaagaagttgattcccaccctcatagatgactttgaggggttctagatattagtggaagaagtaactgcacttgtggtagagatagcatgagtaatattgatagaattataagtggagtttggagatgtacggaattgctgcaatgtaatgataaaactttattaatgagatgttggtttttatggatgagtaaataaagtagtttctggagatggaaacttttcctggtgaagatgctgtgaacattgttgaaatgacaatgagttggaatatcacataaacttgataaagaagcagctggatttgaggattgactccaattgcaaaagttctgttagtaaatttttatgaaacagcattgcatgctgcagagaaatctttcctgaaaggtgcagtcagtcattgtggcaaatatcattgttgtcttattttaagaaattgccacaatcactccaaccctcaggaaccattaccctgatcaggcagcagctgtcaacactgaggcaagaccctccaccagcaaaaagaaaacatgctaaaggctcagatgatcattagcagtttttagccataaagtattttatatatattttcttctagacataatattattgcacatttaataggctacagcattgtgtaaatgttactgttatatgcactgggaaaccaaaaaaattttgtgacccactttattgcgatattaactttattgcagtagtctgtaactaaacttgcaacatctccaacatatgcctgtactgttatttgactgcagtgttaatgctattagcagagaaagaagcaaggctaagtttctaagattggtatatgatatgttaatgtgattggacgtcataaaagtgagggagaaacactgaggaaatttaagcaagggaattaagaagtgtttggaggagaatcacagaaacctcttttggggttaaagagagcactttgtcagttaagtttgtgtattaaaccatgaggaaagttatgagtgccttcattcattaggcatgtgtttgctatagaaagaacttaaactatttaatgtttataaacaatatccaaggatttatcatcagaataatatgctataatacttatgcagagctgtctggtatatttattcctcatgttttattccagaaatatgttttattttgtcttttacaattgtctattttctgtgtaaccatatttttaaaaatattaccttgtctgaattatatacattattattgtattaattatctgttgaaagtttatatggaatagatttcatcgtggatcttagtaacagctaatttaatctccaatttgaatttatttatattttttaaaagaacaagtaagaatataacctaataagatctcaagttgtttgcctgaaacagcccgattgtctttaagatatgactagttaactagcatcctttatgtaactatgcttttaaatccaaatagtggtttgcaagaccctctctttcccttcagttcgttagatgaacttgataattttagcacattcttttatattacattttccttttttgtttatctgaaatattatatcagagtttattatgtctggcaagctgacgttttgcacaaacacatcaatttatctttcataaaataagaaattttctcccacaaattttgacattttgtagtaaatatcaagctattaatctacttctctgtccaaatgcatttaatgcaacttttttataaaatcataaaatttaaaatattgatcattattattaattcattaaaaatatagcatatcttaaattcaagttttagattttggacatgttttcagtatgaatttacatttacatttgaattgacaaaatgtattatcagggttactgtagtttcagctaacttaatttttagcatgttgtcttatcaattattttgggggttttttaaacagatggggaagatgagaatatgaaattgtgtcactaatcagtctttattttgattattgtttgaataatcactgtataatgaataaaattattaccgaagacagaattacaaaggtgcatttatactggcttaagttttaaaactaactttaaatgtaacttgtgtaaacatgtcatatttttcatgggaataccacagaactaaatggaaaacgttatttgcaagagtcatgttctagccatggcatcaacaaataggaatcttcctaattagaacataatagattttacagtcataaatatcccataccctgagaagatatactttcatagaaaatacaaatttagaatattgttgccgttattgtctcactgttttttaaaagcagttggctaaataatcattcttttaagatggtatcatttttaatacattaagaaataatatttcatgtaatgccacctaattgagacacaataacatctgtaccttcttcctttcatagcttttaataaggatatttgaagtcctaagaatactcctgtgctaaatcttgctattgaatctatttattctataaatttcttgaagttatttatttatatttataaatatttctaaattacattcatttatttataataatttatttatttattcagtagttttattgagtgctttctatatactgtctaccaactactgttctagtcattggaagagtgctgtgaacaatatgaacaaggctactgttctcgaggagcttacattttagtggggaaaagacattttaactaatgatcaaccagtaaaataaaataattttagattgtagtttgaaaagcatagttttatacaatactatagagtaagggggtggtaaattactttacatgagtgtctttaagaagtgcaatatttacggtgagacctacatgatacagagcaagccatgtgaagaccagttgccctacatcacttaagaatgattctcctttgtgcttattccttttcctagaaaccaggcttgtccaacttgcagcccatgggccacatgcagcccaggacagctttgaatgcagtgcaacacaaatttgtaaactttcttaaaacattatgagatttttttgcgatttgtttttttgtttttagctcatcagctatcgttagtgtgttttacgtatggcctaagacaattctttttcttccactgtggcccagggaagccaaaagattgggcacccctgcagtttccagttttattagaaggggcctggaactgctgtatgctattgtagacagagaaaaactgagaatagccagatacacttgaacctaatgctgtgcttcatttctttctgctctctgtatcaaattttcctgtttgatctcagcacttctgcatatttttagatgttaaaaagcgatttcttgtcccacccacgtgagtagtagaagacaggatatttttcatgttcttttttctcatagcacttactgagttccaacatattatataatttattattatcgccatttattatctgctctcccactaagaattttttcactgctagcttttatttttaactgatacatccaagtacctggtacaatgcccagaatataatagatacttagtgatttatttgatatatgcataaatgtataccccttaaggagggaatcttgaaagagaatctgattgagttagtgtctgcttggcattgcttactaattttacaaaatcatccttgtatctgccttccatttccataattaattatatcttatttttaaagtatatacctgacaatggactgcaacagtattttccataggcaatttcctgtggaattttctatggaaagtctcgggtggaggaacattttgaaatatttgtacaacaaattgtagtgctgactcttctgttgaatagccagtatggaatatattcaacctgagcctgtagcctccagctgggactccaagtacaaaaactgcttgtgctgagtctacatttactcttgagtgccatttattttaacagatttgttactctgagtgtcccttgcatcagtttttaagaaagtctgtatttcagatggtactttttatagagactttacccatacacttcatcccaccattaatactcattattgtaaaaggtaggagagtattatctgtagcaggagttggttgaggtcttcaatcagtactttacttaatgttcaagtatcatgtgtaacctaatttgaactgcagctgttatttttgataattttaaaaacagtgttaattttgggaggtccaagtgtctcatcacccccaagaagtggtatttcagcttattctctgaaaacaagctggaatcaaaatagcattcatatttcttatgaaaacttttacatttgtctttattatgtttattaataggtaaagatagataatgtaattatttcaagttttagaatgttttggttctttacttcctgacttttacttgaagaagtagtcagtttcctctggctactttatttattcaaatattctttgggcagatgtaaaaaaaatatatagagatgtttcatgtgtgcctatgtcttgcttacttgcctgaaattatgatctttcttataaggtacttagttatatggacccacagatggcaggtaaaccataataaaattctgcagttccagcctgaatcatgtgcttcatcaatttaagtatattgttagtctgttggttactcccactacttatacaccatttaaattaaagaaatgccaaatcctttatatgttaaagaatggcagatatttgggagtgataatgagttaaatagggattgcacaaggggattagtgaagactcatatttgaatattatatattttaataatcaatgcttttttcccctaaaaatgtgccacttgctctttgaaaattttccatctcagttcctttccccacttttgttggaccttctttgttttgtctatatttattttattctgcttaatttcgattttcacttttagcagtttctcctcattatgagaccagtcctggaatagagatttgactggttgcttttgaaagttcatgtactccaactgttccaggcttctttagaacttcctcaggatcccttcaactaacctagtcttgtattgagcaactctacacttctgttttcacttccttattcaagttggcctggcctagttccagttaatacctttttgaaacttttgagttttcctattgattccctctttttcctgcctcatagacactggtaccttccacagcttgagtttgtcatttacccgtaccagtttatgttttgacatttaaggggatagatagtctgccacttacttttgttagaatagttgttctttttttttttttttttggcttttcaatttagctgctatatattttaatattggaagtcaaggatatcaaaaactatcctgctacgcccactgcccactcagaactctgtcccttggattgcatttgttaatttctaagtagttaagcttgttttggccatatgtgaaattatagttttaattttattttattggaatatgttaatgtaccttataaaagctaccatttagatttttaaaatactttctctgtacaatgtttattgtcttctttttaaaatgttctatggattaaaaatatattttaaatcatctgtgttcttgatgatttctgctctgttttgtaacataacttcttgaaagttcagcctgtagtttgtttctactttgtaatgttccacattctccttatattattctgtttatattaacatccccaccactctgttggaagttcatttgtttaaattactcatgaagttcatgttgtcaaatccagtagccatattttcatcctcgtcttaaccaacaaaatcaaccactactttcttcttgcaacatttctgttctttgatcatcttggcacaaccctttcctggtttcctcccacctacctttccacttcttttttttaagctctaatgatggggtggccctgaatatcctcttagagataatttctcctgcatctattctgtctcctagggactatcaaacaagtacatgatttaagatgacatttatgttcctttgatttccaaatttttaaatctaacctttcctgtgagcttcaagctagtagttactgtctactcttgaacatttaataggtatttcacatttaacatattctaagtaagtttttctttccttatttctcccttgatcctcatggcacttttctattctcaataagtagaaatatcatctttccacttgttcttgtgagagcaaactacaatagtcatgactgattcttctccttcattcacctgtcatatctaatctttcttcattcacctgtcaaatctaatccttcagcacgtctcctcacttctctctctaaattatgtacctaactacttatttttgtcttgatgactactacccttgtgcaagctactattgccttatgactagaaaaatcaaatatcctcttctcttatcttctggatttccccaattatttctttctcacccaacagccagaatgatatttttcttgagagttagatcatgtcattcccatagctcaaaactttccatgggttcccattgcccttataatatattccgaactctttgtcatggccaacgacctatgtgacttgctttttgctttctaatctgaatttatttacaactactctgtcctttgctcacaatactccagatcttatgacttttcataaacatgtctaacctaatcatcatctttacacttgagaaacctctaccaacagatatttgtgtgtttttaaacttcttatttggatataagctcatatatcacccctttagtgaggccagcagctctaaccaccggatccaaattagccgcaaatcctcctagctcatatcatctttgtttttttccactcaaaacaccactgtcaacaattgtgatatccccctacaagttcacctggttattttctccctcctgctattagaacataaaagccaaaataataggagctttgtcttattacaatggtgtagaacagagcttgtttagtgactatttcttgaatatttttacatgatttaaatgatttaagtagatcaattttgtgtctctttgatcagataacttttaaaagagatatgcatgttaataatttcttccaaaattttgccattatcaaattccccttatatgtccagagattgtgtttttacttacttggcctgtatttttggtgcatattgttttattattgttatgttttctttgtctcagtgttttatttgatcaggttttgcctttgaatttcactttgctattaatattggtttatatgttttattgtttttaagtgcctattatatcttcttacagtattttatattttagataaaaatgtgtcactgttctatatgtgttttctgctaaaaacgtaaagctgaattgtatctttactgcaaaaatctctgtctttcaatgtggattcaccctgttgacatttactgcaattgcactgtatcttattcagttaattttatgttatgtttattattttatttgttatttcatctgttctctttttttatatatttgctaatttattcaagcctttgttcaaggtccttatgcccccttttcatttaggtatttatcaacattgcgtaaggtttcctcctattccaatttgtcttaaataaactaattttctttattatgatttcaaaatattatcattttgaagatttttcctgttcttaattattgtttccagaattctgttaccatggatttaagttcttgttgacaatattctttgataagcttcctttctatgatattctatggacaaagacctgggaagaaaattcattcttttaaactttaaaagatgttttttctttaatcttttataatattttcacctataaccaatctcctatgccaattatctttcttcagcctttgtataagtgtttcataattcaatagcttagaagcttgtaggaaatgaatattactatatttaagcttacatgtacatgccaaagaatcattttctcaacttactgtaattctttacataagaaatactgacatcccttattttagaatgccatttaaattccttagtgttctttccttgcactggaagctgggacaattataggattaatttcctttgtttttcttcactcagggatcataatctctggccagttgtccaatgcctgaaattggttgtttcagatacttcacctagttttccagttgtttacagcaggagggaaaactcattccttttagtccattttcagtagaaattctattatgtttttgcaacattttcataaaatattattaaaagaaaaagagattttaatacctgaatggtttagcttcagcaatgtgggaaaactcacttatattgacatctcatttatacatgatacaaaagtttaataatgtttatattgtaacttttacatgccagaaattatggtaaacattaaatttctattcagttagattttctataacattataaggtagatgcttttattattaccattcgcatatgggaaaactgagaaatagactagtttttcaaaatatacagggctagtaattgaaaaaccacattacacaatcagttattctctatccagatgctatattgttgattgatatactataatacacttcctcaggacagatgttacagtatgatctctataatgttaacagaaatggagaacgacttcaactttttggctagtttcaccttttaaaattaacttcttattaacattaacaagttttaaaatgatgtgacatattttattatttgaatggtgtgtaacaaaacatttgtatatatatatgaagcttccccagatgaagttatatagggagaaaattccctgttttcttagctgagttgaaatgtgggtgttttggttaggcatatttaatctgtcatagtatttcacatgaaactcttagcgtgcatccttaaagtaattatataatagtttttaaaatatttaatgtcgtattctacactatgaccatcattagcagttggatatattaggtattctagatgaaattttcattccatcacatatttgatttataatatcatgatccaaatgtcttggtgatttagaaaaactgtatttacaaatgtcatgaaatatcaccacaggttttagagaagaacatactttcaattttttttattttgatttttcagattgcattctcacaacacaatacaatcatggaccttgtgcagttttttgtcaccttcttcaggtaaaagtttgctttgactgactttgaacttttcaagcctgtattctgatatatgtcctgtcaatctgttagataatcgaccaattctaaaaccttaaagtatcatagagtatgtcttgaatagctttatatgcttaaatatatcccacagaggagaggtaacatagctgaaatgtacttgtgcaagattattttgctgttatactatttaatagccaatggattcagtggaaagaggataactttgtgtcccccatcacataaataattatagcctgttttaattaatgaaattaacaatgcatgcaccacatggattagttacatctacaagaactaaaccaatttgtttatttcttagttaattttgttaattgtgtgacatattcgttgtaggttcataaaaagggctccacagtgaagcagctttgtaaaatgctacatgtcctaaagttaaatagtgctcttttggttggttttcaactggcattacttctcaaagcttttaaaatgctaatttgcaatatgtcattctacaagagaggttatagtttgtagcatttctcaaaacatgaaaactgttttcagggaacatttattttcatttccatgggatgtaaatgtagagactctgggttaggagtttaagttataaaatatctgtgttatgagatcgtagatcctctggattggaagagatcttatttttgttaacattattattcacgtgtgaagtttatgctggtcatttgggtgcctttgtacaaattagacaaatatgacttctccttctggcagatacagccccacatcatggcacacaaatttggaaatagtgcagtatgaattttaaccaacactcaccaacttggctgggctgccatacagtaaagacctgcacaactcaatccttagcacagatgatgtatttggaacttgtctaaacacaaagtaaccatcatctttttgattgtcttgtccagatatccataaagtatttgaatttctaataccttcttcactggagtcagcaaacattttccattaagggccagatagtaaatatttcaagatttgtgggctgtatggtcttcatcgcatctatgcaacttttctgctatagtgttaaagcagacaaagccaatatggaaacaaatgggagtggctgtgttccaataaaactttattataaaaacagctggtggattgaattcagcctgtggacataatttgcccaaccactgatcagttttatgcctgaatgcctttaatgacaggaagctcactagctcctcagatggcattttctatcatcagataacaaattgttctttataactgagctgaaatctgcctccctatgatatctctcctaattcctccatgtgggcccatatataacaatttcaatttctcatttccatttacagcccttcagatttgtaaagtattttctacggtttacacattccttgttcatttttctacttctcttgataagagaaacctttgccatattggtcagtttactctgaaaacaatcatgttcatccatgcaccttaaaatattataatttctataatgtatttctataaacatatttatcactaatatgtgtaaaaagtgcattcgtactttaaattgttccttaaaatgaaatttgaggaaacatcttaaatatgtttaatattttacaactttgtacttcagaaaacaaatgaattttaaggctattaacaaagttacagtatggttttagaaagtactagaaattacagttgaacaagcattattgaatgcattaaaacaacttttgttgttgttgttgttgttgttgttgttgttgttgagacagggtctcaccctgtcacccaggctggagcagtggcgctatttcggctcactgcaaccttcacctcccgggttcaagcatttctcctgcctcagctcctgagtagctgggattacaggcacgtgccaccacgcccagctaatttttgtatttttagtagatacggggtttcaccacattggccagggtggtctcgatctcctgacctcagatgatctgcccacctcggcctcccaaagtgctgggattacaagtgtgagccaccatgcctggtctaaaaaaaactttttgatgcagaatagtctggaagaaaattcactgaaagtttggttaagtgaaaaatttcacaaagttgaatatgtatgtaaattatttgaatcttgaggttttttattttaagcttttgaatttgtgtgcatatttaaattcaatagctcttttgttaagtaaaagaaaattactgttaatgtgtaccatgtcttagagatgatcctatttattatgttgtcatcatggacaatgtaaaataaaatattctaatctttgggtgtgataaaatatatttgatgggttttttgtcatttaaattcttccagtagtgaaatgtaaattagatcacttaaaaaactgggtcattgttaagaaaaatatggacaggatattttgaagcttatcaattattaagttttataaagctactgctaaactttaggagattttaaaacaggttaacatttatggagacccctcaatcaggccatttttactgttattgctgttattttggtaacagagctgagtgcgtcagctttgcagtttagccattgttctgtaggggctggttctcaaactctttgttagattttacctctatattgtgtgtagttctgatggtaaacataattgggccagtactagggagatcacttacagacataccctggctctgttcttaatgttttatgccatcttaagtaggtcactattttagtttgtttgtattgctgaaaaggaatacctaaggctgggtaatttataaaaagaggtttatttggctcacagttgtgctggctgtacaagaagtagggtgccagcatgtgcatctggtgagggtatcaaactgcttccactcatggcagaagaggaagcggagctggcatgtgtagcaatcacatggggagagaagaggtgacagccagagactcctttaaacagccagctctcttgggaactaatagagtgagaactcatttgctaccataaggacaccaccaagtcattcacagggagtctgcccctgcaactcaaacacctttcattaggctcaatctccaacgatgggtatcaaatttcaatatgtgctttggagggtcaaatattaaaactatagcattctatccctggcccctcaaatccctggtgttcttctcacatacaaaatataatcatttaatcccaatacttcccagaagtcttaacttgtttcagcatcaactcagaagtccagagtccaaagtctcatctgagactcaaagcaagttcctttcagctttgagcctgtaaaatcaaaatcaaattatttatctccaagatacaatggtggaacaaatattgagtaaacatctcattccaaaagggagaaactggtcaaaatatagtgataacatgctgcatgaaaatccaaaatatagcggggaagacattaaatcttaaagctccaaaattatctcccttggttccatgtcctgcaccctgggaacatggatgcaccatagccctgctctactaggcaatccctggtgggtactctcttcagggcctccaaccgcatatttctgctcagcattgcctcactagcatctgtctgcagggtctccacccctatggcaggcttctgcctgggcactcaggcttttcaatacatcccctgaaatctcagtggaagccgacaagcctctagtactcatactttctagcctccttcagtggcagtaggcacaatacctggggccatttgagcagcgagatgtggggagcactttctagagatggggcatggcaatgttgtcccaagcctgtcatccaaaaccataccatcttccttgggctcttggtctgtgatgggaagcccagaagcctgccagatttgtgaaatgccttcagggtctttcccccattgtctttactaatagtacctggctccttttattcatgctactttctttaacaagtgtttgctaccccagcactcttctgaaaacactctttccttctctgccacatggccaggctgaggattctacaaattgttatcccctgctttccttttgattatacattccaactctaggttatttatttgctcctgcatgtgaacataagctgttaaaagcagccacattacttcttgagcactttgctgcttgtcatggacacaatgtagcaaagttctttgacagggcataacaaaggttatctttgcttcagttccagtgatttcctcatttcagtctgagaccctcaacatggcctttactgtctatatttcaatcagcattttggtcacagccacttaaccaatttctaagatgttccaaactttccctcatttttctatcttatgagcactccagttctaaagccacttttacatttttaggtgtctttatagcaacataccacttcctggcaccaattttctgtcttagtccatttgcattgctgtaaaagaatacctgaggctgagtaatacataaaggaaagaggtttacttggctcatggttctgcaggttgtgcaagaagtatggtgttggcatttgcatctggtgagggcctcaagctgtttccattcatggtggaagaggaaggggagctggtatgtgtagagatcgagatcacatggtgagaaagtaggcaagagagaagacagaagttccagactcttttaaataaccagctgtcatgggaacatgagacacaacgatggcacaaatccatttatgatggatctacccctgtgacccaaacacctcccattaagccccacctctaacattgagtatcaaattttaacatttgatttggaggatcaaatatccaaactatagcagtcacctagcttctctaaatctcagtcctttcatatattgaactaaaggtttttttttcttgttgttgctgtgaaataatatagtaaataattcaaaaattgaaaagaataattttttaaataaactcttcttgtgtgtaaaatggaaaagtagatgtatctgagtcagaaaagtctgaattatttattttaaagaactaaattaaatggaaatttggtagagactactatccctgtgttagacttttagtggtggcattaattttctatatcattggatgacattatattttgtatttattaacttgtccagttgggagtagtttcagagattaccagttggtcttttccactatgactgatcttatcctataagccagggacacagtgtagaggttattccagctaccttgtacatcagttctatttatacacttaaagagtggggaaatgaccaatgggtggatccattgacatagtgggcacactgtgagcaagaatttagtcagaatttgttatgtgcccccaccccatgaacaccccaactctaataagaggacatgatgatattttgaatgcttggctatctgtgtctaatgggagtcaattaggccctcatgtctaatggtagtcaaaatgtctgcttattcctcctgtactgtatatatatcctcatgcatataccaatgtatataatcaagtttatggtgtaggtattttcagggatcattttacccacttttcaaaatgtttcagggaccttccttctatggactcagtcacctgattagttaatcggttttggattttaaaattagctgaaatctgggaactgtgaagagaaacatggccctccattgaagcaacaaccctcagtctcctgttccttcattcttacttaaaatgaaaccagatgttaaatagtaccactgttggctgcccacctattttcccttcagaataccatgccttattaataatccctacaactctttgtgagccaacccccttggcagttcgtccaatcttgttgatctaattatggtaattgtggtttctggattctggcagttaagcgctgacacctgtcgtctattacattgggtctccatctttttatggcaattaacaaacctagccctgtgactatctctcgtattttcgggactgctctgaagaggagagccagctctaagcctccttataatactggtgcctctcttatcagcatattcataacagccttaatgcatagtttgtcctctgagtcctcccatggaacacaacctggtagttcttctggcctcctataatataaaccattccagcatatccccttctctcagtgtttttataactttctcttccataagccaggacaacccaggcatttcaatttcacttgtactggacattgcatttttcaggcttctacgagtcactctagcaacaagtttgctccattccctggaatcctcagtagggtattacatctctgtggtcctgaaaatatgcaccaaaaccaatgagtttttatttatccagtcttaacatttcgttgccctttatcaaatatttaaatctggtcatacttccatggctcctgccagtacgtgctccctaaatcttgcatccgtatcaattgtgtaatccattttctttcgtatcaggctcagttgggtcatgctgtgatttaatccccctaatcagtctggcagccaagaaaagaagtggtgacagtttgtgagggggcacctgttacctaagagagaagagagctctttagtgtcttccagcataacgaaatgctaggtattgctagggaagcggttggtaaaaccaacatcctcagaagcattcattcatatattcctattccatatttcaggttcctaggtctcctgaaccatggccctttttgcataacacaacttctttggcttagcattctgtcatctctggagctctgcaactctacaacaattagatcatcatcctgctggtcattcatgttggcatttctgctatcagtcatcagggcctcatttaaagctatgaaagagacccactggctcttttatttagccagtaaatggtttgttaatggccttcagtctctcattatccctctgcaggtatcaatacaacataatgataatcattctactccactctcttttgaaggtgttttccccatcttccaagcacctgaattgctgtaccttcaagtattttctctatcagtgcattttctcaggtcaccactggtgaaatccagcaatttaagtcttctgccaggaactgtgttccacccaccaacatggatgttgtcctcttagcctgccaatcagtgagtgaatcagttcctcatctccatcttaccttctgtttacttggaccataagtcctctgagacacagaagccaagatgggattagataagcaataaacgtgttaggggaacttctgtgaggggaaattgggagaagggaggggagataatgggagaatttgagaccacaatgcctacctgcctttgtgagggagagaagcaagaaagggaaggtgagtgaaagagcctgagaatgcagggcacttctaagaatgtttaacaccagtggtgtagccttgagcaaaagttacccatcaaaggagtcttccatctcccaggaacaggcccgccttggtatttctgccatgtttagtccttgactaaggacagcccttgggaagcatgggctcagtgtgaataaaatgatggatttcagagtgcagtagctggggccactagtcagttatgctctctgccatcagggatcagagaggcacttttttttttttttcccccccgagatagggtctcactctgcctcccaggctggagtgtagtggcacaatctcagttcactcaacctctgcctcccaggctcaagcgatcctcccacctcagcctcctgagtagctgggaccacaggagcttgccatcacagctgactaagttttttgtatttttggtagagatggggtttcaccgtgttgcccaggctggtctcaggctcctgagctcaagtgatccgctcacctcggccttccaaagtgctgagattacaggcatgagccactgtccccagccagagaagtatatcttagtggttggcacaatggagttatttgttgtgtgatggttgatagaactgacctataaaacctgtaaaaaatgattttggtaatgtgtttgtatttatttttgtgtagtttatatttttgagggtagatttttaaatttgactaagtttcagtaatatttgtgtctatggaggtttttaattttttcctgacctagttggtaattggctttttaatggaagttgtactctttgtttcattttataaattcattgacatatttacaatattaatactctgaagtttgttctatattagaattgtgcctacccttttattgagaattttgcctatttttccttccttccctccctccctccctccttccctccctcccttccttccttccttcctcccttcctccctccctccttccttatccttccttccttctttccttccctccctccctccttccctcccttccttccttccttccttcctcccttcctccctccttccttctccttccttccttctttccttccctccctccctccttccctccctccctccctccctcccttccttccttccttccttccttccttccctccttcctttcttccttccttccttccttccttccttccttcctttcccttctcatttctaaaaataatctgcttcagctgcattctgtagacattaatatgtagtatgctggtctcatagaatgatttaggaattgttccttccttttcactttttgggaaaagtttgagcattggtattagttattttttaaatgggtagaatttatcagtgaagccattgagttcagggcttctttgttgtggtatatttgattactgattcaatctccttactggttataaatctattccattttctattcctttatcattcaatcttggtaggttttatgtttctagggatttgtccatttcacctagcttatccaatttattagtgtataattgttcatagtactctcctataatcatttttatttctgcagaattggcagtaatgacccgacttttcatttctaaattttgtaatttcagttttctttctcttttctttttttttggtcagtctaactaaaggtttgccaattttgttgctctttttcaagaatcaacttttggtattgttgattttctctattgtttttctattttctctattgtttatcttgctctaatatttataatttccttcattctgctacctttgaatttagtttgttctttttctagttcaagttgtaaagttaagttgcgtatttgagatctttcttcttttttagtatgtttataactaaatttcccttttatccactgctttacagtgttccatgagttttggtatgttgtgttttaattttcacatttctctaaatattttctaatttcattgtgattttgtctttcaaccattgatcaaatgtgtgttggtaatttccacatactttttaatgttcaagtttttcttctgtttttgatttctaactttatcccactgtgggtggtgaagatactttgcacatttatcttttaaaatctaccgagatataatttgttacctaacatatattctgtcctggagaatgtcttctgtgcccatcaggagaatatgtattctgttgtttttaggtagaatatcctgtatatatctattagatcttggtggtttattgcattgctctagacctctgtttcctttattatcttctgtctgattgttctatcctttactgagaatggagttgaattattgttttaatcatttggatttctctctgttcctattgttactttttgtcttaaagaacatttttaacttaaatatagtatttctttattagaatttgtctatgtctttttgcatatcttttaaaattttttctcttgttatattttgtgtatgtttcttttataccaaaaatatctggatattttggttttgttttaataatctgggaatctcttaattttatgtgacagggaaataaatggaaattttcttttttcttctcttctgatttttattaattgaatgagcttcttattaattgaatgagcttctaatgttcttttattttccttttagcagtttaagaattatagttttttttatttaatgattactcttaaattttaacaagcatatttccctaaccaacaataatattaatcagtatgtcttttatcctcctgaatcatataggagaactaaaaaacttcaaaacttttacttatcattgtctaatttttaaacgttttccaatttctaattttaatttgtgttttatttggtgatataattcacatataatacaattcaccaattgaaagtgcacagttattcttcaaccattattgcaatcaattttagaacatatcatcatccccaaaagaagccatgtactcatcagtagtcactccccccttttacatacccctagttctgaaaaatcactaatctactttctgtccatagatttgcctattctggacatcttatataaatggaatcgtacaatatgtgttcttttgtgactggttcctttcattagcacaatgtttcttatccgtaacgtagtatggatcagtactttgtttctttttattgctgaataatatttcatcttatgtgtataacacattttatttctctattagttgatggttatttgagttctttcttctttttcactgttgtgaataatactactatgcacatttgtgtgtaagtttttatgtggatatatattttcatttctcttaagtatataattaggagtagaattgttgatcacatggtaactctaggttaaacattgtgataaactgccaaacatttttttaaagaagatgtatcattttataatcttaccagcaaggatcagacatttattttttccacattcttactaaagtttgtattaactgcctttcttatagccatcttagtgggcataaagtggtaagagatgatgcatatttagaggaattaaaaatgaaagattaaaggaatctaaagaatacaacaggcaaagaaataataagagttaagcgcttgaaaaacaagaacaatcaaagatgactacatggaagcaagcatgcaagtgagcagaataatgcaaagttaagtatagtgttcatgatttgggaaaaataagactttttattattattattatactttaagttttagggtacacgtgcacaatgtgcaggttagttacatatgtatacatgtgccatgctggtgtgctgcacccattaactcgtcatttagcattaggtatatctcctcatgctatccctcccccctccccccaccccacaacagtccccagagtgtgatgttccccttcctgtgtccatgtgttctcattgttcaattcccacctatgagtgagaacatgtggtgtttggttttttgtccttgcgatagtttactgagaatgatgatttccaatttcatccatgtccctacaaagggcatgaactcatcatttttatggctgcatagtattccatggtgtatatgtgccacattttcttaatccagtctgtcattattggacatttgggttggttccaagtctttgctattgtgaatagtgccgcaataaacatatgtgtgcatgtgtctttatagcagcatgatttatagtcctttgggtatatacccagtaatgggatggctgggtcaaatggtatttctagttctagatccctgagtaatcgccacactgacttccacaatggttgaactagtttacagtcccaccaacagtgtaaaagtgttcctatttctccacatcctctccagcacccgttgtttcctgactttttaatggttgccattctgactggtgtgagatggtatctcattgtggttttgatttgcatttctctgatggccagtgatggtgagcattttttcatgtgttttttggctgcataaatgtcttcttttgagaagtgtctgttcataccctttggccactttttgatggggttgtttgtttttttcttgtaaatttgtttgagttcattgtagattctggatattagtcctttgtcagatgagtaggttgtgaaaattttctcccattttgtaggctgcctgttcactctgatggtagtttcttttgctgtgcagaagctcttgagtttaattagatcccatttgtcaattttggcttttgttgccattgcttttggtgttttagacatgaagtccttgcccatgcctatgtcctgaatggtaaagcctaggttttcttctagggtttttatggttttaggtctaacgtttaagtctttaatccatcttgaattaatttttgtataaggtgtaaggaagggatccagtttcagcattctacgtatggctagccagttttcccagcaccatttattaaatagggaatcctttccccattgcttgtttttctcaggtttgtcaaagatcagatagttgtagatatgcggcattatttctgagggctctgttctgttccattgatctatatctctgttttggtaccagtaccatgctgttttggttactgtagccttgtagtatagtttgaagtcaggtagtgtgatgcctccagctttgttcttttggcttaggattcacttggcgatgcgggctcttttttggttccatatgaattttaaagtagttttttccaattctgtgaagaaagtcattggtagcttgatggggatgtcattgaatctataacttaccttgggcagtatggccattttcatgatattgattcttcctacccatgagcatggaatgttcttccatttctttgtgtcctcttttatttcatcgagtgctggtttgtagttctccttgaagaggtccttcacatcccttgtaagttggattcctaggtattttattctctttgaagtaattgtgaatgggagttcactcatgatttggctctctatctgttattagtgtataagaatgcttgtgatttttgtacattgattttgtatcctgagactttgctgaagttgcttatcagtttaaggagattttgggctgagacagtggggttttctagatatacaatcatgtcgtctgcaaacagggacaatttgacttcctcttttcctaattgaataccctttatttccttctcctgcctaattgccctggccagaacttccaacactatgttgaataggagtggtgagagagggcatccctgtcttgtgccagttttcaaagggaatgcttccagtttttgcccattcagtatgatattggctgtgggtttgtcatagatagctcttattattttgagatacatcccatcaatacctaatttattgagagtttttagcatgaagggttgttgaatcttttctgcatctattgatataatcatgtggtttttgtctttggttctgtttatatgctggattacatttattgatttgcgtatattgaaccagccttgcatcccagggatgaagcccacttgatcatggtggataagctttttgatgtgctgctggattcggtttgccagtattttattgaggatttttgcatcaaggatattggtctaaaattctcttttttggttgtgtctctgcccggctttggtatcaggatgatgctggcctcataatgagttagggaggattccctctttttctattgattggaatagtttcagaaggaatggtaccagttcctccttgtacctctggtagaattcggctgtgaatccatctggtcctggactctttttggttggtaagctattgattattgccacagtttcagatggtgttattggtctattcagagattcaacttcttcttggtttagtcttgggagagtgtatgtatcgaggaatttatccatttcttctagattttctagtttatttgcgtagaggtgtttgtagtattctctgatggtagtttgtatttctgtgggatcagtggtgatatctcctttatcattttttattgtgtctatttgattcttctctctttttttctttattagtcttgctagctgtctatcaattttgttgatcctttcaaaaaaccagctcctggattcattaattttttgaagggtttttttgtgtctctatttccttcagttctgctttgattttagttatttcttgccttctgctaggttttgaatgtgtttgctcttgcttttctagttcttttaattgtgatgttagggtgtcaattttggatctttcctgctttctcttgtgggcatttagtgctataaatttccctctacacactgctttgaatgcgtcccagagattctggtatgttgtgtctttgttctcgttggtttcaaaaaacatctttatttctgccttcatttcgttatgtacccagtagtcattcaggagcaggttgttcagtttccatgtagttgagcggttttgagtgagtttcttaatcctgagttctagtttgattgcactgtggtctgagagacagtttgttataatttctcttcttttacatttgctgaggagagctttacttccaagtatgtggtcaattttggaataggtgtggtgtggtgctgaaaaaaatgtatattctgtggatttgggatggagagttctgtagatgtctattaggtctgcttggtgcagagctgagttcaattcctgggtatccttgttgactttctgtctcgttgatctgtctaatgttgacagtggggtgttaaagtctcccattattattgtgtgggagtctaagtctccttgcaggtcactcaggacttgctttatgaatctgggtgctcctgtattgggtgcatatatatttaggatagttagctcttcttgttgaattgatccctttaccattatgtaatggccttctttgtctcttctgatctttgttggtttaaagtctgttttatcagagactaggattgcaacccctgcctttttttgttttccatttgcttggcagatcttcctccatcctttcattttgagcttatgtgtgtccctgcacatgagatgggtttcctgaatacagcacaactgtatgggtcttgactctttatccagtttgccagtctgtgtcttttaattggagcatttagtccatttacatttaaacttaatattgttatgtgtgaatttgatcctgtcattatggtgttagctggttattttgctggttagttgatgcagtttcttcctagtctcgatggtctttacattttggcatgattttgtagcagctggtaccggttgttcctttccatgtttagtgcttccttcaggagctcttttagggcaggcctggtggtgacaaaatctctcagcatttgcttgtctgtaaagtattttatttcttcttcacttatgaagcttagtttggctggatatgaaattctgggttgaaaattcttttctttaagaatgttgtcctattggcccccactctattctggcttgtagagtttctgctgagagatccgctgttagtctgatgggcttccctttgagggtaacccgacctttctctctggctgcccttaacattttttccttcatttcaactttggtgaatctgacaattatgtgtcttggagttgctcttctcgaggagtatctttgtggcgttctctgtatttcctgaatctgaatgttggcctgccttgctagattggggaagttctcctggataatatcctgcagagtgttttccaacttggctccattctccccgtcactttcaggtacaccgatcagacgtagatgtggtcttttcacataatcccatatttcttggaggctttgttcgtttctttttattcttttttctctaaacttcccttctcgcttcatttcattcatttcatcttccatcactgataccctttcttccagttgatcgcatcggctcctgaggcttctgcattcttcacgtagttctcaagccttggttttcagctccatcagctcctttaagcacttctctgtattggttattctagttatacattagtctaaatttttttcaaagttttcaacttctttgcctttggtttgaatatcctcctgtagctcggagcagtttgattgtctgaagccttcttctctcaactcatcagagtcattctccgtccagctttgttccgttgctggtgaggaactgcgttcgtttggaggaggggaggtgctctggtttttagagtttccagtttttctgctctgttttttccccatctttgtggttttatctacttttggtctatgatgatggtgatgtacagatgggttttcggtgtggatgtcctttctgtttgttagttttccttctagcagataggaccgtcagctgcaggtctgttggagtttgctagaggtccactccagaccctgtttgcctgggtatcagcagcggtgtctgcagaacagcagattttcgtgaaccacgaatgctgctgtctgatcgttcctctggaagttttgtctcagaggattacctggctgtgtgacgtgtcagtctgcccctactggggggagcctcccagttaggcttctcgggggtcaggggtcagggacccacttgaggaggcagtctgcccgttctcagatctccagctgcgtgctgggagaaccactgctctcttcgaagctgtcagacagggacatttaattctgcagaggttactgctgtgtttttgtttgtctgtgccctgcccccagaggtggagcctacagagacaggcagacctccttgagctgtggtgggctccacccagttcaagcttcccagattctttgtttacctaagcaagcctgggcaatggcgggcgcccctcccccagcctcgctgttgcctagcagtttgatctcagattgctgtgctagcaatcagtgagactccgtgggcgtaggaccctccgagccaggtgtgggatataatctcctggtgcgccattttttaagcccgtcggaaatgcgcagtattggggtgggcttgacctgattttccaggtgccgtctgtcacccctttctttgactaggtaagggaatttcctgacgccttgtgcttcccaagtgaggcaatgcctcgccctgcttcggctctcgcacggtgcgctgcacccactgtcctgcgcccactgtctggcactccctagtgagatgaacccggtacctcagatggaaatgcagaaatcacccgtcttctgcgtcgctcatgctgggagctgcagaccggagctgttcctattcagccatcttggctcctcccaaaaataagacatttaatcatgttgtacataaacatattttgaaagagaaaaaagaagaaaatgtaactccctgaagaaaaaaggtgaacctaatttagtcacaggatctctacatcaaagagatataatcctagaatatttgccaaaaagttttttaaacaatgtgtaaggacactgtgaagaattacaaatacaaaaaagtctctgtttaaaaaaataagattatgatgatggatatggtaatggaaatgacacctgaagatatggattttgctaagtagaaacaataaatgatttcttactgtactggaagttcacttaggaattttctccatggtttttttgtggaatacagtagatacttaggacctaactgttcttgtaaaccaaaatatttaatgcggtgggagtaaactagtgatggtacgttttcttgcaacttagttaaaccagtgctccccatctagtttacaaagctgaggtttatcgtactagacactgaaatagacttctccaagagtcatatcagtaacttcacactttgacttaaatattgctttacacctcaaacttaacatgctttaaattgaatttactgtactgggaaacagtctctttttttccagttttctgtagctcagttataggtatcactatttaactcacttgaatacttgggactcatttaaatcctctttccttaatgacctacatgaacatcagttctaacttctttgtatcaatatattatatgtaaattagccaaagtggtaatttaaacataaattattaactccactgtttaaaatcttccttttacatttataattcaaagtatgagtattctcatacttaaagtataccagtcactttttcattgttagagggggcagtggttaattacttgcctttttttccagcatttttttggtccttattgtttgttttttacttctgttggaagcattttaaaatttctgtgcagtaaaattccttttgcggggagtacagttgtgtgagttttaacacatgcatcatttattataattaccagctctcccaggatacagaacaatgccaaagccccagtgaatacctcatagagccttctttgcagtcagactttctccccacccctacacgctggcaaccattgacctgatctctgttcttgcagttttgccttttccagaatgtcattcaaatggcttctttcccttagtctactgcatttaagattcatccaaggtgcttttttgtatcaatagtccatttcatttcattgctaagtagtatttcattatatggatatatcacactttgtttatccattcacccattgagagatatggattgttacagtttttggtacttataaataatgctgctgtgatcaacatacatacaagttttacacaaacataagttttcatttctctagcataaataccaggaagtagggttgctgggtcacagggtggatgtatattcatctttataatagctgccactgtttttcagagtgactgtacaattctgtgctgcgaccagcaaagctcagggttccagttgttgcacattctcaccagtgcttggtcctgtcaacattttttattttagccattctgataaatgtgtagtggtatcttgtggtaattttaacttgcatttccttaatggctaatgacgttgaatatcttttcatgtgcttattagttatactttcattttctttggtgaagtatttttcaaatcttttgcctagttttaattgctttttagttttgctgtttatttttgaatattgaatgttttttgtatattctggatacaactcttttgccagatgtgatttgcaaatattttccctcagtctttgaattgtcttttcattctcttaacagtatcttttatggagtgaaaagttttagtttttataaaattcaatttaatgcatttttttaaaaacttgattatgcttttgacgtcatatccaaggactctccctaactcaagttaacatagatttctttctaacagttttatacagtcaatgcactacataacattttggtctatgacagaccacatatatgatggtacttataagattatattactatatgtttactgtaccttttctatgtttagatacacaaaaaccattgtgttataattacctacagtattcaatacagtaacatgctatataggtttgtaccctagtaacaataggctataccaatggctttcatgtgtagtagggtataccatcagtgtttgtttaagcaccctctatgatgtttgcacagggatgaaatttgtctaatgatgcatttcttagaacatatccccattagtaagtgacacatgactgtatttttacattgtacctttagatctgtgatccatttcagttattttttgtttatgttgaggtgtaattcaatgctgattatttcacatgtggatatcctgttgttacaccatgatttgttataaaggaaaaacctttccattttgaaatgcttttgcaactttgtcaaacattcaccatagggttccagttccaggtaagattgtgtaaacacacatctctttttctctaagtgaactcaaccatgaaacctggacaaaattcatgggcagctatttggtatatgatatcagcaggcagagcagagaagaacaccagaattcaaagtactggtgaaccatctagaagtttgccatttttcccctttagtgccccctgacctgaagtcaatgcaatttgaaacttggaagtaactactatagtttggacagggtaaagtcctctagttctggcccatgatgtggaaaagggaactcttaagctcagagagaatgagggagacctccctcccattttttctctttttcctgaattcactcacccataccccaggcagtctgaagcaggaacatgggcagcagcaaaatggctcacagtgggaagcagtaagaaccacaatcccaagggaagggaatattcctctaatcatagtggagctctggctacagagagccaagataaaccctgttgatttccttcttgtctgtcctcccagctcaaaacatggtacaataggaaaagtgtgtagtttctgaccacatgatggaaaagtagagcccacaaatccagaaaggacctaggagataatggagatagaaaagccttcccatcaaatgttatggggtggggggagggggagggctagcattaggagatatgcctaatgtaaatgatgagttaatgagtgcagcacaccaacatggcacacgtatacatatgtaacaaacctgcacattgtgcacatttaccctagaacttaaagtataataataataaataaataaataaataaatatatagtgctttataaacttctgggatctctcctgagctgcctgtgtgctgatctgatcctaattaacattatcatacgaaagaattggagaactgagctcatagatagaactctgctttgggcccggactgaacagtgggtagccctcccgctgcactgactcaagaagcacttcaaaagctttggatgcattgtgaccatagcctccagatggataaaacaaattatctctctagagaatatcaacattatttataaataatacctcaatccctttgtaaagtcaaggtagcacaagagagatggattaaagggtacagtggaggccgggcatggtggctcacacctgtaatcccagcactttgggaggctgaggcaggtggatcacgaggtcaggagttcgagaccagcctggccaagatagtgaaaccccatctctactaaaaatacaaaaattagtcaggagtggtagcacacgcctataatcctagctacttgggaggctgaggcagaattgcttgaacccaggaggcggaggttgcagtgaactaagatcatgccattgcactccagcctgggcaacaagagcaaaactccgtctaaaaaaaaaaaaaaaaggggggagggaacagggctctaatggaagtagtcattcttaagttaattaccaagtcaaggactatctctcaatgtttagtgctttaagaaaactttcatcaggtactagatctattacctatgcgtatgggaaaggtgacatttgatccctgctttgaatataaaataaattctaggaggaaaggtaaaaacaatgaaatatctagaaggtaatgtaggaattattcttcataacattagaatatagaatggattcttaaagaggacacataaaatactataacaaaattagactacaaaaaaacctaacactttttcttatcgaaagacaccattagcattatgacgagtcaagtcacacagtagtacgaaatatttgcaaactgtataaaagccaaaggccttatattcacactatgtaactcatataaatcaattaagaatagtctgaaaactcctttctccaaaaatgacaatagactgacatacacttcacaaaagaagacatccaagtgtccaacaaaatatgcaagagtgctcaacttaatttttatctgggaattcaaattaaaaccacaatgtaataccattatatacctactacagtggataaaaagaaaaagacaaataataccaaatgttggagaggatgcagaactattcatacttttagtacactagaaattgatgtaatggctttgaaaacaagttgacattatattctaaagttgaatttacatatactctgtggcccaacaattccaagtcatcaaagtcatgtgaaccatatttatagaagcatgttttacatgccccaaactgggaataatcaaaatacccaaaaataatagaatggaaaaatatactcatataatgtggagcaatgggaaaataaaacgattgccaaaggatcaaaataggtaacacgaacatagtgttgaatgatagagacagaaacaaaaaaaatactatagtgttatatttgtaaaaaatttagcaatagacaagactgaagtatggcattaaaaataaatgtgatagttccttttgagaaggagagaatgaattaagttctgtttcttcaagctggtggtttcaagggtatattgtctttgtgataatttattgagctatatacttagggtttctctattgtgttatacattaatgatttaggaaaggttttcaaaataattaaaatttttgtcctaactatatggttttaaaagatgtgcttcaaaaaacatttaatgtaggaagaaacactgtatacattgtcctttgtcactttttgttgcaagtttggaagaataaggtattatccaagtaggctacttgtaataggacttacccaggaagattttccttattagatattagtctttctaatatgccatcagatgaggcttgagactactccattttctgtagagttttaggaaaaaatttaagagtgactaaagatgctctgtagcctcaaaatctgttacagattttgaggttctgttacagaaccgtggcagggaggttaatttaggtactcttctataaatttttcataaatgatatctagtagattttattctttcccagccttcatttaactccctccacgtggctgtgtagcaaaccatccaatttaaatgggatttatctctcactagcttcatgattgtgccaatgccatttattgcatcgtcaatgtttggtaaggagtgggcatgtataatagtgtattatacaagccttggaactgctgcgttcatttttgttcctaagaattaaagaagcctgaaaataaagttggtgcgtagtgttatgcatagtccagagaatcataagaaaatgtagctaggaccctgatcagaccaaacctggaacttttcttcctttggactttgggaagtgtcttagtgtgcttgggctgccataacaaaataacacagactaagtgggttaaacaatagaaatgtattatctcccagttccagagggtagacagttcaagatcagggtaccagttgttggtttctggtaaaacctctcttcctggctctgcaaatggctgccttcacactgtgtactcacatggcctttcctccatgcatgcaggaagagagggagagtatgcaagttctttggtgtctctcctttaaggacattaattatatcagatcagaatcccatgtttataaacttcatttaaacctaattatgtcctaaaggccctgtcttcaaatacagccacactggggggttagggctttaacatatgaatttgagaacacaattcagttcataccagggagtgtaaacttcatgtagatctcttctttataccagtttgagttaggttttctgttacttgcatttgaaataatcttaactaatagtgctcctaaggtacagtaactcttgcttaacaaccctcagaagtttgaccaatttattctatgcgtgtattatttaccacattcagccactgggcttttgatttttcatctttttcaaactgatgacttgaacatataagcaattttttctttttaatattcatatttttattgcattttaagttagaagtgtattctgttaatatgttcgtttgtaagaaaaaatcctttaaatgtcatgaaggtataaaattgaaagatagtttgtggaataacagttattaggaggtaaatttcttcatttcaacacaatttccctgtttctaacatttttcagtgaaatataataatatgcccaaaccatcttttaaaatatgtacttaagacttgacatttatgatcagttaacctcaaattgctataaaatagcgacaatattatctctttttacaattggccaactagattaccaccagagggtatttatttgtcacagcaacctgcattacaatgtaacgttatagcacactatgttacttatattgaattcttttaattttccctaaatgagattacctaataagttccatttttttacattaagaatcctttcaaaatgaccattttatgaataataaaatcaagttattgaaatatctctccctaagtttttatgcttcccttttttattcctgtagctgatatacttgctttttaatgtttgttttctttctttctttctttgttctttttactccctatttcctttgggtggattgtactgaggggtgttgaacctttcagatcttttgatattattatcgtacagcatatttttttttgaaaaagaaagcccaattattcccccatcaatatctatatcatggagcataaaagcttttgcataatgtgataggaaaagaagacctgaaagaaagcagtagatacttattttttctgtgacaaatttgccacagtaccaaattaaaacatactagtgttcaatgatacccattaaaccctttgatttaagagatagagaaaagctaactggaatacacaaacctacaaatatgtcacttaacataataaaagtttacaatgcttctgtgtcacatcaagtccagtgggcaaaaaaggagccagtggaaggtgtagtaggctgttcttgcaatgctataaaaaatatctgagtctggataaattataaagaaaagagtttaattggctcatggttctgcaggctttacaggaaggatggtgctggcatctgctcaacttctagagcagcctcaggaagtttacaatcatggtagaaggtgaagggggggcaggcttgtcacatggcgaaagcaggaacaagcaagagagttaaggaaggagaagtgccacacatttttaaatgaccagatcttaggagaactcactcactattgtgaagtcagcatcaagccatgaaggatcttttcccctgacccgaataccaggccccacctccaacactgggattacaattcaacctgagatttgagttgggacaaatatccaaactatatcagaagggatagcatggaatacaggacactgcttcacatggtcatttaagaaattcagatgatggaaattctgtcattcttcaggtgtccaagattgtcaataaagacggagactctctagtagtcaccaaaggaagaatataactttttaactatgctgaataaatatgacaaatatttattgtttgcctgtttgttttgctttttagcaaagcaagtgttcttaaactgttttttgtttgtatgtatattttttaagagaactgtcacttttgtttgcaatgtaatttattagaaatcaagaacatttataaagtattaccctatataaggataataatgccaaatgagacattcagtattagaaaaaatgatgttattcaaatcaatttaaaaaccaatttagggaggctgaggcaggagaatggcgtgaacccgggaggcggagcttgcactgagccaagatcacgccactgcactccagcctgggtgacagagcgagactccgtatcaaaaaaaaaaaaaaaaaaaaaaagaaaaatcatttatttagcaaaaatgtattgacacctactatctcccaagtagtaacatatattttactggatttttgatatttactggagattatgagaatattattttaaaaatattttcttacactgtttattgattttagtagccaagtttctacgtcacgttagctcttttactgctaacctaataggaattaccatagaaagcatctgacacaaacccttaaagtgtataactccttgtttcaagaaagtgagattatgaaaattgtatattttatgttgtccttatacatcattacaaaaacgataatcagttgagtcataaagtttagataagaaagaatttaagctcctcatgagaaattcaactagtattcccgtctcaaactgaatctttattatgtaactcttaaggaagaggaatgttgtgaattattaatcatataaaaatacattttggtatttaagttgtatctactgaatataagtaacttttctatatacactattatttgctacgacagattttctgaaagaaactgttgacaggatctggtatctggatgtaagggatgatataattgaaatgtaaattgtttttaacattttagctggaaagtaatggtgaaacagagaagtcaggggaaagggaagaacttgcaatttaatactttgaaccttagacagtttacttcaactctctgtgacttagctttcccatgttttaaatgaacacatgacagtatgcttgatctatcacctgtaattttaggaattaaacaggtaattcatgtaaaacactcagcatagtgcttggtacatattactcaatagatgttagttgcttttctaatcatgaacattattaatggttcagcttggacatggtaggtttgaggtgatattaatatttgtatcacagttcttaagggtatgatggtctgactgaaattcagaaaaatgaacccttagatcatatctaaagtgtccattctcagtaccatattttaagagttacattggccaggtgcggtggctcacacctgtaatcccagcactttgggaggctgaggagggcagatcatgaggtcaggagatcgagactatcctggccaacatggtgtaaccccgtctctactaaaaatacaaaacaaattaagtgggcgtggtggcgcacatctgtagtcccagctactcaggaggctgaggcaggagagttgcttgaacccgggaggcagaggctgcagtgaggctgagatcaccccactgcactccagcctgggcaacagagtgagactctgtctcaaaaaaaaaaaaaagttacactattattccaggtataacaagagaagtataaccactatgataataattcagactagagaagggttcctcaaccttggcaatattagcattctgggctaggaaaatgctgttggaagggcgacctatatattgtatgatatttaagtaacatcccactagatgcctgtcaagtgatgaaacccaaaaatgtctctagatacactgccagatatcgcctggagaacaaaaacattcctggttgagaaacactgtacttgaggcaatcctgcatacaagaaaacctgtatattctttaaatatataaagaagttttagcatacagcagactgattttgtttaacctagaaggcagacacagcactggttgataaaagttagaatattggccaggtgtggtggctcatgcctataatttcagcactttggaaggccgaggccggcagatcacctgaggtcatgagttcgagtgcagcctggccaacatggtgaaaccccatctctactaaaaatacaaaaaaattagctgaggtggtggcatgcacctgtaatcctagctactcaggaggctgaggtgggagaattgctgaaatctggaaggcagaggttgcagtgagccaagattgtgccactacacttcagcctgggtgacagagtgagactccatctcaaaaaaaaaatatatatatatatatataaatatatattttcaaaatttgaattaactagaaagagaatgcactaacttgtcagtcagcaacttctcagctacaatgagtatttaattaggtgctggatcactatcagagctgtactgggaatttccttcctgggagggacttgaaactaagaaatcttttatagccctttcaaggataagatgctctcattttgacaggtgtaaagatgcagatttggaaatcatttaaattgaggtcgtagttgaaatcaggaaaataactgagctttctctttgggggcaagagaaaagaagagcacaattgcatgaagtgaattttaaggaatatccgtaatttaaaagagggaatttggaatgtaacctatattcatttaacctatattaggttaggaagtattaaggaaaacaaaacaaaacaaaatgaaagaaagtattcaggagagagttttaaagaatgaatgattggtattgtcaattgagaagttaaagtctgataatagagaaagcaccagtttatacaatttctagaaaatcatggtgactttctgttgaaagcaaattctgagaaaagtgtcccctaaaatattgaatattacataaagggtgctatgttaaaaaatcacttgtatggttggaaaggttagtatcactgactttttaaaaaatagatttcctttgattctggaggcgggattagagaatggatatggaaacagagtgattatgggatggatagtgggcacacttagagctgccagcatatggaaaggaaaaaagtttgaggcttaagtagctggatttgtattttggtactacgacttagtccgtgtgggactataagcaattaacttcaaaatctctgaggactggattcctcttttctcaaataagaatagtatatactatcttgaaggatttctaagactaaatccaatcatcgatgtgacgtactagcacagcatctggaatgtgcgcagcactcaatggatagatgttaaaattgacattgttgttatcgttgtcattgaaggatattctaaggtcttctgcttcaaatgaggcataggcaaggagaaaaaatatattgaagacttgacaagagtggaaagtgtcaaaaattgccactgcttatgagtgacttaagtgatgaacacaatgattaaggatgagaaccaggtttttcttgtaatgtccagtgaccagcgaatttgtagtgtcccaggtctgttcacttctgggtcttctcatagcataatctatgaccacagagcaaagaaagggaaaataaacagtgatacagggttgagattgattaatgagattcatgtaaatctctgtcattttgagatttgtcaggcttgagttacttctaacaaagtaccctgcattatcatagtttattgcatatagtacctaatatattagaccacatgtatgaacattgtaactgacttatttcttaaagtaaacattagcatatgccagggtttctcagcctcggtactactgacattttgtattgctgatcctttgctgttggggacagtcttgtgcattgtagaattcttgcaacacccctgcactcctctcccagttctgacaaacaaaaatgtctctagacattgccaaatgattgccaaaagggttgggaaccaaaggttattttggttatttaatatgttcatacataaaggttatttaatatgttcatatataatatgttcagatgtaatttaatatgttcatatataaaggttatttaatatgttcatatataaaatagtgataaaaataatataaatgtacatgtgtgacgtttggatttataaaatttccatattttataactcataatagcaattctaaatagattttggttgtgatttctgttgcttcataagaccaatgtaattataaatttacattccttctgacagagaaaattctaaatattgaccataatctatagcaagaaatataaatattttttctacctgtacattttggttttgagagaacattttaagcattggaaatttatcatatttttgattgtttacctagacaaagttattacttatatatatatgtatttgagtctttcatgtactgttttttcattacatagttcaaataagttttgagcaaaaattatttgtgttttattttccagttgtttcctatccttattgctggtggctgctgtggtatggaagatcaaacaaacttgttgggcttctcgacggagagaggtatcagtaatattatttaatcttttgtttaaagatttaagcaaatatatggatctctattgtctgttaattaccatgctctcttggaatgcagaatttcaaatcatttttacatactaatattcaaaaatcactctagtattttttaagctgtagagcaaactttatcactgtaattttaagttagtatttgtaaaagcattggtttgttgcaaacagtttctaaaaatggtattggaatttatagtgaatacaattattatgtttaaaaaattttgtaatatatttaacaggcatttagttatgctataaagacatactttatttttcataagcgtctgttgaaatttaaaattctgagtgataaatatttatttttggtttttgaaaaatattttatctcctagaaatttattataacattctttttttgggaatcaaatcttttccattttctgattatctaataatccaactctgtttaaagagcacatccattggataaatttctgtattagaattatttttctcgtaatcctaaaattgatgaaaacaataatattcttacaaaataacaactgattatataaattgtgtatattcgttaatcgaaaggaacgaagaaacaaaatcatctgaggagcaaaagtatgcagtagatttattgttcatacctcatttattcaaaaaactagtttctgtttttatcagtattcttttattataatgtattctattgtattaatcttaatattttatttgctattgcatttctccatatatttctatatggatggtttttgtaacaatataaaacaacagtataattgcttaccttcttttttccacataaaaaatataatatttaaagacatgtaaaaataatccagagtgttctaagctatagaattagtgagtgatatgggttcttcttagtctatttttaagcacccatcaaagatcagtactatctataatatatttgcaaactggagtccctccctgtcttcaaataaatcattcatcttaatactctctgcctctctgattttctgtttatggccagtgcagcatcagtgagggtttacttggaatgactgtatgttaaaaagtaatcccatggaaaaagagcttattaaatataaatatataactattaggcaggaagtggaattctctgcagaggtaaacaatcttctagacatgttagatgatctattacagtaaaattatagattcaggaaggaaaaatcataattataggcaggtagtgtgaaggccttccttccctaatggaataaggcaagtgacaatttatgtccttaatcattagaagagaaggctgaatcaatcagggagcctctgttcccattgcatcctgaggagcactatttaaatatctgatctctaaaatttataaaatgcatctatgtaaatatagcattgtgaaaatatcaatttgtaagtaaaaaatatctgccattaactggcagctgaatgtaagtaagttgtctagttaaatttccttacctcttaaaagaaggatttgtaccctagagctaattctcagttgtggtctagtcttttgagccctataaatgtttacatgtagtagctaaagtttagaaatgatatttaatatttgttaaaactaatatgaatagtttagctataaaactttcatacttctcaaaatgacaaattgattttggctaatattgtattatctcagtgtagtaatgctgtttattacatactaatcaggtgctctggcaagttgatactacttcaatttttaaaatatagatataaatttatcttttggaagtcaaaatctttcaatatatgtggtagatgtggaaaggataaaagacaaatagtagaggggagctagattaggatcactttccagtttttatctgtattattaatattactgtgttctctggaaattcctttaatataatgcccttctttccaaaactcatccaggtagtgcttctttctattaaagtgtataatagtgtttgcatttaatttgctactgcttccgaaaaagaaaatgtatcttgagggtttatgttatgctatagcattacatgttaaaacatattttgaggaattttctgaaatttaattttactaaattcctttaaatgtaaaattctaaatgttatagaaactattcatatattgatgtccaaagtaaagatgacattgtctttgatgattattaaagatctgcaattagcaagtaattttaatattacaattgtccccccttatccatagtttcagttagtcaaagacaattgcagtccaaaactattaagatattttgagagaaagaaatggtgggggaggtgggaagtgacagagagagagagaccacattcacataaattttaggacagcatattattataattgttctatttcattattattgtggttaatctcttgctgtacctaatttataaattaaaatttatcattggtatgtatgtatagggaaaaacatagtatatatagggcttagtagtatccacagttttaggcatcctctgggtgtgttgaaacatatttaaaggggaactactgtgttaagaaattgtttttcattttggtcttaagagccctggagatttttaaccacactagttgtagttatgtgataattccatttatagactttatgtgagtggaggtaaaaatgtgtttatatctaatcctctctttattcagttttaaatattagattaactgtaatatttcccaaaggaaaagaacccactattatttctttatgtgaatgttactgtctcttcaaaacattgaagaaatcaattattgtaaagctcagaggacacctttgattagtaaaatgacagtttatctgttacagtaaatgaaagttacttaaaggattcttcttagaaattatgtagttttatttcagcagttatactagttgcttttctaaatgtaatgaaagtttaaaatgaaaataatctttggaaatgttttaatatattgtgttcattcaactagatgtgttactttttaaaccaaagttttgttttctcataaacatagatatactttttgtggcataattttaaattcagaggatagttagtcatgttatgacttttgaataacacccctgagaattcaggggctcttaaacacacattaaaaaaatgaaactacacacaaaaggcttcaattttgatatgaccccttcatacactaaccccaaacaaatttctgtggtgttaaaaagatgaaaactttcttttgggatgcgctaatgaatggaaacaataagtgtatattgataagtggaaatatttacactagaaagatgaattcatttatatagcttgtcctttttacagcggtattaaaaacatttagcttcaatggcacattcagttatagtcatcacattactgaaatatttgtcaggagcaagtatatgtaaaaaggagtctattgagctatttttatgcttgataatcttcattcttaatctgaaatttgaatattaataggtatcataaggcagaaaaatatgaagatattataattgttccctgcaatgaagatatttgatcatatatttggctatcgtgtgaaaatatgatgcatattttaatagttacaagaagttaatttttttccattttgagttgtttaaatgtagcatgtctctgtgaaactttaactgcaaaatctgtagaataatagatccataggcaaaggaagggttatttttacattaacttcatattactagtgagtctgagtatttgaataatctctacatttcatgtgatagcaatttttccatttttaattcttgtaaatttacagtttttttaagtttaaaaatattttaatgtagaactttaccacactactttttaatatttctcacatattacacttctcttctgcttcaaaatgaatacaggaaattttggaggataagacatgcccaatgagggattgaatttatgttcataataccctatctccctgcatattttgtaatcatgaagaataaaacttagatttgcattttttattatcaccctgaaatttgagttaaaaataataaaccaatacccacaagtagaattttagtagctttgagtaacaaactggttttccagaggcaaatacattagttctttccttctatacctgttttactggtacaaatccagacaaaagtaataatattaaactgtactttaataatgacattttatggtgtataaaccaattagttataaaatattctctgacgcagtgataaatagattctcatctaagtaatattaatgcaatgtagcagtgttttataaattaaactactcttttctccttagacactaaatatatttacagaaagaagattcggcacagaataaaaacattaaggaaaatgtgaaagtgttattttaggtggataaattcaaattaactgataaggtactgcctgcaaccttttgtagaatttcatagcacttcaaagttctgtattttgtaaatgtttaaacattttaacatatagataaagctttccattaaacacatgctttttaaaactcgttagtaaatatttcactcaaataaatgcctttgcagttaatggccacaatgtcaacttactgttgcttgtcatttgctttttattgaattgcaaactaaaatgattattattgtattaattttcttcctttatcctatgagactagaaattacaggtcttccgcatgcctattgcattatcatactttcaaaattttaacataaatttactttaaaataacttgagaagtcaaatatgtatgcagttaagatttgaaaaataactgatacttaccttgtaaacctgtttccaaagacttcatggtaaatatagtgctttcattttgctcagttcaacaaaggtgtatcaatttcttgctatattatagacaaattgataaatactgaggatataaagaaaaagatataggccccattattggggaatttgtagttttaaaacatttcaataaggcagacacacacacacacatacacgtgcaaagttcttaggggagcacctggatttactttattgtgatgtcatgcatagggagatagaatatatcgaaaagttttctggaagtcagattagtaatggaagtaaatgtgaactgtttcataattatacacaggattaatttcaaaaaaacccctaaacaaaaaaactttgggcactgtttttactgtatatacaatacaacaaatttgtctaaaatcactttttctttattatatgctattatctttatatttagacccagttacttagactaaaacattatattgatttattctaaaaaatgtagtctcgctaaccacaaaatcttatctgtattatatattcaaacgaatgtatatctcgatatatgtgtctgatgtttatgtgtgtatatgtgtttttatgctaaaaagttcattttttatctaaaatgcaaacttaaccaagtgttctgtattcttatttgctcaatctggcaaccctattttcaacacaaatgctcaccctggagctcaggggtgggttcaacctcataaaatccacaggaactcagagagaagtagaaaggaataattttctaaagttagaatcttgatttgttttcaaaataagggggagttatactgggcaagcaaaaataaaagatgtttactccgtatattatctatcaaaattaaaaactctttgactcaatggttagatttctgaaaatatatcttaaagatatatatctgcctagcttttcaaagtatactcatatatagacacttacagagagatttttgtatatcagaactatttcatatcattcaaaaagattcgagaaagaaattctgtgttcttacagtgggatattaggtaactgaaaaaaagaatgaggcatatttgtgttaatattaaattagtttattccttcaacaaatatttattgaacaactattgttgtttcaagcacatttttagacaaatacagcaatgaacaagccaaataaaatcccagccctcaaaaatgtttacagatcttaaaatctatattattaactggaaaatatatgacatagtttgtatgatgtttctatttgtataaatcacacatgcacaagcataatgtgcatggaaattgtgggtctgttggtatttgataaagaagattgactgtgttatttgataactataatataaacaaatagtcaaataatgggcaagttgagagaacatgatctaacattttaagttaggcacttaataaaaatagtatttaattttcacactaaaaatatatatatttgccctttacctatataaggaatttgtggagactagagtgcaatgctcaaagcttacaactagtaaaagaagaagctgtaacttaaaaccaagtctgtcagaccgaaccatacagagaactttagagatagcctgagtttgaacaagttggtttcataatggaccacttataatgtaacttatgcatctgtttgttgtactggaaatatgttatatttcatctgatattatgacacaatcattatttgatgtaccacttacgaagaaaacacagtacttattcaactattgcacaatgttcacttcccactcagaatatttattttctacttattgaaagagctcttatatgattatttagatataattttgtcatatgtcattcatatttatacagagaggaaaataaaagcaaaataaattgggtaaagttttgctacgacttattcaccttcatagtccaagtttttaaaaatcactttttgagttaagcaaaaatatattgtatgtttcacatagtatcattgactagaataatgaagtttatgtctgtgcagacaatgaaaactacatcacaactgtcatctggccagcagtgattatataatgtcattgattttaaaacacattagagtttagagatattaaaatgtgaaaaaatgtttcttagaatcaatcaaatatggtagaaccttctttataaggtgtttagtactaagcgaattaatgcatactaaggggttaccccactgcattttacctaacagacttcaataaatattagctgttattgatatgtaatataaagaatgatcagcattatacattaatattactaacaacaactcctgtatatcttggactcctcctccatttctactgtaatgcaatggttctcaatctagtaggcccttgagaatcacctgtggatctttaaaatgtgtgtgtgcgtgtgtgtatctgtgtgtatgtgtgtatttgcatgccattctactgttccatccccatcagatatacaaaatcagaatttctgtgagtgaggctcagccaagtgtgtttattattaaagccctcaaatgttctaatatgcactattggcctagaaacactgctttagcttctactctgacagagctgggaaactgtagaagggtttccaacaaacttgtaaagatatctgagttaaaaggatctgattttaagctgatcactgtgcttctgtgttcactccaagtaaaattggtttatggagaggagttaaatttttaatgttaagtttggtacatctactagacatctaattagatctatcgaagaggcaggagttgcatctggcatgaggaaacagagctgagtaggaagctaaatttgggaatctcagcacatagatggcatttgaaaccctgagcctagataaaattacccagagaggaggattaagccctgagacattcaaatttaagaagtcagagagaagacaagcacccagcatgaatactggaaagcagctaccaatgaaggtggagaaaaaccctgagcttctggaagccaaggaaacactgtataaaaaggaacagagttatcagttgtctaaaaaattctggtggttcaagtgaaataactgaaaattgaccattgtatttagccacttagaaatcattgctgaccccaacaacagcaattttagtggactgatggatgcaaaagtttgactgaagtttgatgagaaagaatggaacaagatgacttccagaatggcagcaagaggatcccctgagacctattctccagacaaacaacgctaactagtgaaaaaatctttaaaaaacaaacaaccgactgggcacagtggctcatgcctgtaatcccgacactttgagaggccgaggctggcggatcatgaggtcaagagatcgagaccatcctggcgaacatggtgaaaccccatctctgctaaaaatacaagaattagccgggtgtggtggtgcacgcctgtagtcccaagtacttgggaggctgaggcaggagaattgcttgaacccaggaggcagaggttgcagtgagccgagatcctgccactgcactccagcctggcgacagagcaagactccatctcaaaaacaaaaaaacaaaaaaacaaaaaaaaaaaaccatttaaaatacctggaaatagttttaagtgcatacggaaaacaaagaaacacttgttactggtggagggtcttgagtatgagttgcccgggtccttggagatttggacaaagtattgaacaaaatgcacaaagtagcagaggaatgaaatgcagcaaagaagcagcaaaagcagaaacttattaaagagagaaagcactccacagagtgggaggaggcctgagcaagctggtcaagggcctggatgcaaagttttctgggttttaagtacccaatttgaggttcttattggctaccccttatctggaagaaggttttgtctgtggctaaaggctgaggtgaattggcagcccatgcagataaagggatggtccctgctcggcctgtggcctatccaaggcactctccctttccatctgagatgtggcggaagggggagggctgtagggagagtagcttttgatcctttgttactcagcttggggagagggttctttttttctttttggtttagttttaggaagtttgtattaattggcctcaggttccctgcccccaaacctaggcgttttccttttgatccagctttgggaagtcagcatgaattggccctagattttctgcccccagaccttggtgttttctgttttagaaatttgctcaaattggccttaagttccctgtctgcagaccctattttcctgcctcaaacttatttaagaaaatctactaattctcagtaagaacagcaaatctatagcatttgagcctcaacttgctcccttcctacccccttctagctcactgtgactagcacttctcatccccccagctcccttttgcagatgctatattccagacaaaatcagctgaggcctgaggctctcttcttctaatgagccccacttgtatggcaagaagctcttctcaaggcatagcagcctgataataacagggacccagtctccctctctccaccttgcttatagggcagaaatttcatgactggcgagataatatgagaatataaaaaagtaacacctctgctcaacaccctgctcatgaagcaggaacattatttaagagagttatgggccactgtccccatcattagctctagagcttgcacaaactagcaaaatcaattcaaaaagataaaatctaaataaacctatagcaagcacagagattgcatttgttatttttaaatttccaattagatacatcaacattctgtttgcaacaagcacatctagcacccagatcttgttttctaatattagagaactctttccagtggttcctccattcctgacatactctcattcttggtgtttgtgtgtgtgtgtgtgtgtgtgtgtgtgtgcgcgcgcgcacgcacgcacatgcgcaacccttcttacgttttggtaccataagaaacttcaggtttagcttgtacacttcttgccccagtcctagaattagctatttctccaaggatctctggttccctttattttagcatacatattgcctagatcttgatttctaaataccattcaccaataaaaggagcttggatgcaaatcacatgagaatctcaatagatatagagaaagcatttgacaaagtccaacaaccttttaccataacaacacccaacaaattaggaatgaaaaggaaatcctcaacctgataaaaggcatctgccaataacccacatctggcatcatacttaactttttttaaatcacttatatcaggaacaagtcaaggatgtccactctctctaattctattcaacattttactgtatatagtagtcagagcagttaggcaaagaaatgacataagagccatctagattgggaagaaagaagtaaagctatctctatttgcaaataacatgttttgtaaataaaattctttagaaatccactaaaaaacctgttagaactaatacacaattttagcaaggttcaggatgccagagcaatataaaaatcagttgtatttctatacattagcaatgaaaaacctgaaagtaaaactaaaaacgaattcaattcaaaatagcatcaataagaataaaatacacaggaacaaacttaacaaaagcagtagaaaacatatgctatgtgtattagtccatattcacactgctaataaagacatacccaagactgggtaatttgtaaagaaaagaggcttaattgactctcagttccacatggctggggaggcctcacaatcatggcagaaggtgaatgaaacttattcactatcatgagaacagtatgggagagaccctccccatgattcagttaccttccactgggtccctgctatgacaggtgggaattatgggagctacaatgcaagatgagatttgggtggggacacagcaaaaccatatcactctgaaaactataaaacattgttgaaagaaattaaagaagacctaaataaatggaaagatactatatgttgatggattcaaagactttatgttgttaagatgacagtactcccaaacttatctacaaattcaacatgatacttatccaaatactaggtagtttatttgtagaaattgacaagtagatcctaaaatccacagggagaggcaaagggccctaaacagcaaaaacattcttgaaaaagaacaaagcttacacttcataaattcaaacttactatgcaagtatagtaatcaagatggtgtgatatggacataagactggacatttggatccatagaatgtaactgagaatctagaaataaactcttacatttatagttgattgatttttacaagggtaccaagacaattaaatggaagaaagattcatctttgcaacaaatggggctaggcaactgggtagccacaagcaaaagagtgaagttggacccattactcgtatcaccatacacaaataaagtcaataggaatcgatacaccaatatgtgacacctaaactataaaactcttagaagaaaatacagaagaaaatcttcttgatctttcagaatcttcttagacatgacatcaaaagaaaaggtgattaaagaaaaaaaaattggaattcattgaaattaaaaacttttgtgcttaaaagacaccatgaagaaaatgaaaatacaacctccagaatgggagaacacttttgcatatcatatatctgataagatatttgtatctacatatgcaaaggactcttccaagtcagtaatcaaaaggcaaattacccacttaaaaatgtataaagaatttgagtaggcatttctccatataatatatgcagtttgccctttgtattcatggtttccacatctgtggattcactcaaggattgaaaatattctgaaaaaatgttgaaaaatataacaataaatataaataaaaatacattataacaactatttacataacatttgcattgtattgggcactataagtaatctagaaatgatataaatgggaaaatgtgcataggttatatgccactatgacaccatttttaaacaatttacttgagcatctctggattttggtatccttgcggggatcctggaaccaatctcctgcagataccgagggacaactctgtgtgtgtgtgtgtgtgtgggtgtgtgtgtgtgggtgtgtgtgtgtgtgtgtgtttgtgtggtcagtaactcatgaaaatgaaaagatgctcaacaatgttagcattagcagaaatagaaatcaaacctacaataagataccactaaatgcttgtgatcgataataatgttattattattcaccaataatcatcaccaattatcaccaaaatgttggtgaggctgtggagaaattagattcctcacacattgttgttgaatatttaaaactgacactttgtagtgtaatacactctgacaattccttgcaatattaatgtttccatatgacccagcaattccactcttaggtgaatactgaagaaaaatgaaaacgtaggtctatataaaacttttacgttaatgtttatagcaccattattcattacagctttaaagtagaaatatcccaaatgcctaacaactgatgaatggacaaataaaaggtgatatatgtgtaaatggaatattattctacattaaaaaggaatgaagtactgatgcatgttataacaaagaaagatccttgaaaacattaggcaaatctaaagagacagtaagtaaattcacggttgccttgtgctgtgcttgggtatttgatggaatgtggggccagatggagaatgattgttaatgggtacatgggttctttctgggatgatgaaaatgttttaaaattagactgtggtaattgttgtacagctttatgaaaaatttaaatattattgaatcttatgctctaaatgggtgatttacaaatttctttgtagaaattgacaagcttctttgttgaaatggtttggctgtgtcccacccaaatttcatcttgaattgtagttcccataattcccccatgtcatgggagggacaagatagagataattgaatcatgagggccgtttcccccatcctgttctcatgatagtgagttagttctcttgagatcagatggttttataaggggattcccccttcactgggcactcattctctctcctgtccccatgtgaataaggatgtgttcagttccccttctgccatgattgtaagtttgctgagtcctcccagccatgctgacctgtgagtcaattaagccgctttaccagtctcaagtatgtcttgcacaaattgggcttaagttcataaccagtgtgagaatgggctaatacatttctagaaattgacaagtagattcaaaaacttacatggaaatgcaaaggaccctaaatagcagaaacatttttgaaaaagaacaaatttacagttcctgaattcaaacttactacaaaactatggtaatcaagatggtgttattatactacacagtatatttcttagttcttttgtgttgctatgaaagaacatacctgaggctgggtgatttataaaggaagaaggtttatttgcctcatggttccacaggctgtacaagaagcatgggaccagtatctgcttctggtgagcgcctgttaaagcaacagtgtaagattctttatattgcataaattactgtggaatgatagtaatatagtttccctgaattttgttgacaggatttgacatgttaaaagttgagtttgcaggtgataatgctacctgcattccatattaacttcattcatcattctgtaaattgttgcttaaaatatagaatttccttcatttaaagaattatgccataatttgcacatccgtgctgagcaattctcttcctaccaccacccacctccccttacaggggaatttgtttgctaggtatatactgttaacaggcatttatatacagatttaaacctaatacagaattcagcagtatgtattttatatataaagtttcttctcatgagcttttaaaatatattctactggttctaatttaaggaaaaaaaagctttaaacaaaataattttattgtgatttgaacatagttataatgctttattaattttctgaaaataaatttagtcatttaacaatacatagttgtcttagtaactattttgtattttatctcagaataaaaatatgtttgcaataatagcatcctgaataattggctttcacaataattcaaccacattgtaaggaacatggaaataggtaatatattgaatgacagatattgtgcatactccatcactagcagtggttcactataacagtgattctcaaccaaagaggatatcttaaaataatataattagaaaaaaaggcctagtctggttgattttgatatcctcattagataagtaattctgttctcctcatgtccaagaatcacatctgtactggaaatcatgctgaactggtgttcgacctgtactgtccttatctataaattacagggtattcctgctgcatagtatatttatttatttttaaattattttgatgccagcataattatggtctaatttagtttattgtcattcactgaaatgattcatgtactttaattgtgatatttaggtaaaccattattagagtatattgaatgaacatggtattagattcatgcatgaatgtaatattgaaaatgttaactattatagtatattaattatttccagtctgaaatccactgttactatattgtaacaattatgaagcattgtaaccagtactttgaacaagggcagtcaatcaaagcttgattctgtattcccacagcccattcaaactcattttctgtggccaatttgttctagttccttgagtagctagaattgaagataatttttttcttatatctctttttaatagatgtatgtttttcctttccttggcaatttggtattataaaattttattctattaatggaagagatttttagaagtcatctcctctttattggaaataaacatggaaagtttgctatcaaatcaagcattatttttataccttgtacatgttttcatatctatttttaataggtgatatgtctatatgtttcagagttcaacattgccaccagcattacccacccactcaattattctctcctctctatagccaatcagtgttatcagggcttttttgtgtgtgtatagttttctgaagttattttatacatacagaagcaatatgaatatacatctttttctacattacttacgctaataatagcatattctttataacctgtttttgtatatttttgcatgtaactgtaaagttctaataaattattataattctgaattattttgcaacataaaaaataatatttcacatctattgatgagaagtcaaaactgtacaaacttattttcattatagtcacattttgaacactttatatctttatttctctttactatttatttctacagtggagcatttctaatgcacttagaatattcttttagagagatatttttaagaattccaggataccaatccagctatgtaattctgagaaataatttttagaaccacactacagtggagtacctctcaaaaactacatggctctaactcaagtttataacagtaatataaggaaaatgactgagaatttcagtaggaaatttaagatgcagcaagctaaattacagtcttagagaattaaattaaaatgttggcaaactgctttagatcatgttataaattctatgaaatatgacaataatgtaaaataataaaaaaaggcttctgctactttttccttcatttaaatgaatgtgtgtgtgagtttgtgtgtgtgtgtaactgctttttatgttggtgtagaaagactatgtaattgcatggttattatgttatgcaagtatacatttgtaccatgttattgtgttgagtaatggtacagacttacggcattcaagttctggctttctacctatgcatttatagcaattaatatttattactttggtcctaatggcttgctttggaaattaacttagaatgacttagaagcacacactcatcaactactaatagcttatggtacaatagcatccaaatttcaaatctatacttggtaagtattttcaatcaaactatgtaagattataattaaaaactttaaaagtcgttatatattttgcaaatttaccatttgattatttttattatttattattgccatcctaaatttttctactagtataaaagtatattttgttcttaaaaatgccaagttattgccataaaataacattaatttccatagacgtacaggttagcaagattctactcagtctatttctctaaaattgtttgagtaaaagtgttagcttcttatttcttatttctattcatgctgaagtagtgacattgtgaactccaatgacatctataattggtaaattatctttgactttcagaaaacacataattgtttaaacaattctatacgatagctatagttttctttttttcattcttttttttattattattggagatggtgtcttgctgtatggcccaggctggtcttgaacacctaggcttaggcagtccttctacctcagcttcccaaattgttgggattacaggtgtgagtcattgcacctgggcaagagctgtagttttctaatcaaagtgcaagaaatatgctattcttagaagctggttttgtgttatatcatttaacatgaaacacgtatctcctgtagatgtggacaatttattattactttcagaatagttatttgcctaacagaagagctaacataaattaagcagtaaatcagttttgcttcctttagataattagtaatttacatataacctttggctattcttttatcttaggttattgatataagttgcataaaattgttttctatgtagaatgttctttgaaatgcaaaatctaattaaaatgcactattttaggacagttgagttgctaaatgatattacggagactattatgaatattttaggaatctgagtggagtatgtaagaaagctaaattataacctctatggactactttaggttactttatcagtcggctgaaacaaggaaaactgcccaggtacttagattattggatttttttacatatactatatttagaaataatgcaattatgactgtattatgatacctagacagtttcacattaagttacacattaatgtttgcaagatacactaaggttagtaaaggaggctaattgtggctgtagttattctgcccaggggctttcacatgcaccccaggaggctgctcaaaacaatgagtatcaacacatttataatcacttaatggcatacttattgatgaatcatattccaattactaacaaccgaaattcagttttgtggaaggcatggtaaatgatatacctgtttgtccagccaggacaaacaatgagtatttgtcaagagcctcctgtttgcttaacaaacattgtttagcaaggacccaatactgggtaaacaactgttgcatttagttttcaaactgaacatttcttaattttatagtgaagattgagtgtagaatcttatggtagctgtgaaatggtatgtagctaggtgattattatctagaatcttaatgtattaaatcacagtttagtgacgttaatattttacaaattaaagataatgcttttttagactgctgtccttcttttcctttaatatgtgtggtaaagtgaactactgtgttttaattactctttgatgtgtattgggataagtttttctaaatgaaaacatatctcattttgtcctgaagattaattcaaaattagagtttgcctaatgaaaacttttccatttaattttgcagatctattttatgcagaaatttatatcaattaaaagtacatatcacatgatttagccagggatggcatgcatgctagcaacctattaaaagatgaagaattgttaagattcatttcacttttgctgtctttgttgatagttttagtcttttactccaaaattttaatcatatactgattcaaattctatgttgatttgtaattttagaataatgcaggaactttttttaaattttgttaaaatgtacttattttgaatgtttcctaattagtgaattacctgctcattagtgaacaactaggaggtattttaatagcagttagtttaatgagaatggtgaaaaccaaatacattctccaaaaaatcttggcaaggagaataatgcataataagtaacagtcacaatgtctatgatctctttttgtttaacctttataaaacctgtatagttttgctacctgatgagtgaaatatttggtggtagcctgagtactgtcatcctttatctagttgttattctacttaatacgtctaattattgtgcttagaattacttattttttcttaatataaatgtttgttggatttcaaatgaaggtgactttgatgctgaaagctgacagttaatggtaacagtggaataacgttttatgaatgtaggtacgtagaatcatgcctggcagaagctattgtcatacatagtaagtggccagtgctcttttgttcaggctattaaatcatagtgatatgtgttatttcagctagaggaaaaagagaagtccttactcaatattgaaattcacaagatacagaataaattataattggtttcatcttttttatgttaaaaatttaatatttaaagttaatttaattatctgaatacaggaatgctaaacaatttaagtatatccattgaaaagaggatgcccaattactaaagctatgttctttttgctttattaaagattttaaagccagcaacatcactttggtagtgatattttcaggtaatattgatcataaagcatatatattcatgtctacatgaactggatattatcttaaatgtctttgccagaatttagattctaaatataaagctctcagcaagttcttaatgcttggaaaaaattcagcttttgtcttagcaagaatgtgaggtagtgcataaaaaacaaatgtaggttcttctatactagatttttaaaaacgaaatttgattttggagtgttaggttttatttcaatttaatttaatttttaaaataagtaatatattaacataattcaaatttaggaaaaaataaaaagttataaattaaaaagtttcacatttatctataacctagtccacactttccctccctgccttcatagataaacacttgtttattatctatccttccaggtttcctttatcaggatgttgcatattccaatatcaacatatgcaaatgtgtaaacatgtatccctcctttattatacaaaaataatatatttctgtatttcgttaaacctgagttcagacaatttgcacaacatttttgtgtaccaccaagaaagaaaaaatcttggcaattaaagggtgacagcattgattataaagaacattgcaatgttagaaatattagaatgtgaaaaacctcatctgttagagttgaagaaatatggtatgtaccctctactacatattactcttgtcacttatcaatataacttggatatctttccattgccaacctcttttgtttcttttattataaatgcattctattttgtagtatgattataccctaacttatttagtccctataaacagactcttgatgtttttctttttcattgttatgaactttgtacattgttcattttgtatgtgtgcaggtataattataggataaattccaaatgggattgcttgcttaatggaaattatatttgtaatttttatagctatgagcagattaccctctgtagggttttaccacattattttcctaccaactgcatgaagagtgttttgtcaaactttggatttttgctacctgctaagtgggaaatgatgttttaaagtggttctgatttgcacatcttgaagaaaagcaaagccaaaaatattatccagtgttcaagggtggtattttctttttctgcaaactattcatgtcctttactcatttttcaattagattgttaatctttttattctttatttctagaagctctttaaccttgagtaggataactgtttgtctctggtatgagttgaaaatattttttctctgtttaccatttaattctttaaatactttttttttttttttaacaatgtattactctgttaaagctgctgtaacaaaataccataaactgggtggcttataagaaacagaagtatatctcatacagctctggaggctgggacgtctaagatctaggcatcagcagatttggtgtctggcgaggggctatttcctgattcatagatggcaccatacagctgtatcttcacatggtgaaaggagctagctagctttctgctggagtgcagtggtgcgatctcagctcactgcaacctctgcctcccatgttcaagcaattcttctgcctcagcctcctgagtagctgggattacaggtgcacaccaccatgcccagctaatttttgtatttttttagtagagatggggttttgccatgttggccaggctgatctcaaactcctgaccttgtgctccaccagccgtggcttcccaaagtgctgggatttcagctatgagccaccacacctggcctctgccatctcttttattaaagcactaattccaatcatgagggctctgccctcataatctaaacacctccccaaagaccccacctcccaacaccatcaccctgggggttaagatttcagcatatgaaattttgaagtttacaaactttctgaccatagcaaacatgaagatatatttatgcttgatttcaaattttgtaaacttcttttatggtttctggaatttgagtcataggtagaaagactcagcttacttcaagtttacaaaggagtttacccagttatggcttcatttttacattttgtgtatactattagcttggtcaccccccagtgacctcagtatccagattttcatgcccatctgtactctctgtattgactgtagatgggggctatgaatgctttgaccagtcaactgtggttggagtgatgtgttggtagttttatgtttagcccttaattatactgacagttgtttttcttccctctttggagcttactaatgagatgctcctttttggaatctagctatcatgtataaaggcatcctcagggagaggcctatatccagagagctgacactgctagagagtgacctcaactgagccctcagttaggactccacgtgagctctcatttgagccttcagttgatttcagacatcccgagcaacccaagcatagggtttattcataatttgagcagagctcagctgggatagcttatctctccccaacatggcaccggctgggccagcttcactggggatggagaatcttccacccccattaactaagagttcagcacaggctgttggctaaggacctcaattttcctccatatgggcctatccatatagccgctggcttttcttataccatggcaattgttttaataggaggcagcttctagtccttttatagactagacctataatttccacagtgtcacctgcacctgtattatattggcaaaatcagtataggaccaggtcagacataaacgtgtggaaaaatggattgtcctgctttttcatggaaggaaggagtgatgaagaatttctatctttgatctgccacacatttaaatatttgcttcaacttaccgttttccagatagctgttaggtcattccaacactatctattaatacattctttacccccatattttgagatgctgttattactgcatgttatattcccatatacttttgggctttctgttagcttctgttgaattacccatccagacactactactacattgttgtaagtattgagaccttccaatgtattttctctctagtaggctggctgcttctcattttttgcttgtgtaattttgttatgtattattttgctataactattttgctaaatagattttataaagggtttgtgactttctggagaaaatagcttggtatatttattgttagagttaaaattataaattaatttgcagctattacctttatgatattgaaccttctaattcatattcatatattcctattactattcctaataaactaatatttctattataaatgttatttataaaattataaaatattcctattcatataagacatatttctgtgtcttaccgtctgttctacttttgtgtctttagggaatttaaaaatgttttccttaagtaggttttgtatattctctttcaagtttatatacacacatagaaaaagccatgtattgtatgatgtttatatgaaatgtgaagaaaaagggaaatataaagagactacctagagatggatgttggaatgaagaattattgcaaatggacagaagtttggttttgggggtgatggaaatgttctaaaattagattgtgtaatgacagttatattactctaaatatattacaattcatttaattgtacattacagtaaattttactatatatatagtattgcagtaaaaatgttaaaagaaagtcatagctctggctacagtatggagaatggattataggggaacaagggaagaggtagggagaacaatttggagcccagggtataagagaaaatagttgtttggactacataggtggtaatagaggtggagagacagaggaaaatttaggatttgtttttgaggtcaaatatattgtcactgctgatagattggatgcaacgggtggggaaaaaaaaagactaattctcactctacaatctagggttttaccttcaaaaactaggtacatggtggtaccttaacctaaaccataagaactgggagagacaaaaatgtgagggaagttagacagcagtcaagagcatcacttgaggtaaagtttgcaatgcctaaaagagattcaagaggggaaggttcacatagcagttggacataaagacatttggatatacaagtctgagattccagagagaggtctgggattccagagagagttctgggctgaatctataagtttcctaattaataccataaaatttatattcaagatccaagtcttgattaatgttaaatactgtttgtcaggggttgtttttgaaatgggagagttccctgattccccttgcaggacatatgattggggtgtggcttgcctgtttggttgccctgcagctcaaactgcttgagggagggggagcatgcagacgggcagatgcagaggccaggtgagcgctttgggctccaactccactgtagtgtctaggggtgagtgtctgcaaccccagttttgcaaagctctttcagctttgccttccgcagaaggcttgagtgttaatcagtttaatggaccttctgccttattgcaagggtaaagaaccagtgtgacagatttctgtatcctaagctcttgccaggcatcttggaagaattggatcacatgtgggctcaaagggtgagtgcaaggttttattgagtggtagaggtggctctcagtgatacggatggggagccggaagcagggatggagtgggaaggtgatcttcgtctggagttgggccacctagtggccggactctttcctgacttcccccagccaaattcttctcagtgttcagatgtccctcttcttctctctttctcccctacattgttccattgtctgtctgcttgcctcctcatcaatgtcctcacttgctggtctgctctggagcttggggttcagggtttacatgggggcaggatgggggcatggctgggggtaggatagggagtgtggcaggccaaaaggcagctttggggcacaaaaacagaaatacctgttctcatttagggccacaggtatccaggcttgagggtggggtctttgccggggaaccgccctcttctacccagtatttccctgtctcctgtctgtgttattttcagagcagaagtctcagtgtccttgggaatgttacaactcagtgagcaagataaataggtaacacaaagtgttaaattccaataccaggtgaaggcagatggttagaatagccttcaccaaataggtgccatttgagctatcaagaatatgtagccctttgcttgatagataaattggttaggatgttattaaaagtcagtatgggcacagagaaggtccttggaaaatactagcagttatgacagtaccattgctttcaaaatactgaataatcaaatgccaggtatgtaattaagaaaagagttgaaagacaaagctgaaaagatacttctgtgtccgattgtaggagaacctgtgacagacaggaaagaaatgggtaatctaaacttctgtaaaccacttaaagcagaaaattctttgggaagtagttatctcaattatttcttgcaaaatcatgattctgtttgtcttacttacgataaaaagcaaactagcaaactacagctgcagttttatatgtataagtacagccattatatataattgtatatataatacatatatatgtgtatctatatatacaaatataactacagcaatatatataactacagttatatatacataactacatatgtacatgtatatatctataactatgcagatatatatatctacatatgtacaagtagttttgtatatataaaactacatatatataaatgtatatatatatacacacatgaagcatgaatgaaactctttgagaaaaaagcctatagttgccaatgctattccactaaaactaattccttcaaatttacttcacttgtttttaggaacttatatcaaaagacagtaactagtatatcattatcaaaaatatttaatatcaaatctaccatgtatcttaatcttttatattttctgcaacttgtactgaatatttggctgaaattccttgctaaatgtgttaccatctacttcaatctcaatcacatttaaatcctatgttacttgggcaccagatgctccttagttgatttctgcatgctgatttcaggagccctagaaattctctggccattgctgataccaaagccagttaaggtttgctcagccctgttattgactaccaatttcctacacatagggtgctggcacaagactttccatctgtctgcctttttaattttaaacatagcctattttctttgtaaaatattagaaacatctcttaaacaaaattgctaatagacaaatgtaaatcatttggaaatggctataacttgtggaaattggttgagataatatttcaaaacaggttattgcattttaggtctgactcttaatgtgaataatatgatgtaactaaacttatagatattttaaaatagaatcttagtaaacattgttgctttttccttgcaccttttaaactcattgttatagtggaaagtgcttaaacactgtttatcccaagaatttataaaatatattattttaaaatatcagattttaaaaatgatttaagtagagcatgtgatatatattcatcttttaccacttaatgttgagttttagaaaatatgtgttgttaatggaccatcgactttcaagtcattttgtttactaagcttgaactgagatttgagcaattatgtgtgtagtaaaacctttaaaacagaatgcattgcattaaagaatgttcatgttcatttgcaatgaagcagagaatagtgtcagaactctgccctaactaggattaagttgagaagtaaactctgtatactttcttgcatttattatctgaatgtctgaaattttagtgttgttgacatctggagtgtttttcaacatgttttataatgtgttttactttcatttcattgttcatcacgtagtcatttgccgttcctgttagtgttttccaagtgttagaaacctttttctttctgcatgctaatgtcacctacttgccacaattgcatttttgcaaatattcttttttattttttatttatttttcattgcatgtgtttaaggtgtgcaagataatgttttgatatacatatacatagtgaaatgattattataagtaagctcttacctttttttgtggtaagagcacctgaaatctactctcttagcaaattttcaatatacaatacagtatttttagctatatccttctgctatacatcagatctctataattagtcatcctacctaacttcaagtttgtactttgatgaatatctctccttttgctctgcctctctgcccttgaaaaccactgttattctccctatttgtatgtatttgaacttgttttaggtatcacatatagatgagatcatgcagtacttttctttgtgtctggttcatttcacacagcataatatcctcctggctcatctatgttgccacaaatgccagtatctctttttttaagagtaaatatattccatggtatatacaccacaatttctttatccattcatgcgttgatggacacctgagttgtttccatatcctggctattgtggataatgctgcagtgaacatggatcacagctagctctgtgatgtgctgatttcgtttcctttggatgtacgtatacaaagcagagagatttctgagccataggataattctttttttcattttttgaggaatctcaatactgttttcaataatagccatgccaatttatgtttcaattaatagtgtacagggttcacttttctccaaatctttgccaacattttttatctcttttttgtaatagccatcataacatgtgtcaggtgatatctcattatggttttgatttgcatttccctgatgattagtgttgttgagcacttttccatatatccgttagccatttgtatgtcttatttggagaaatgtctatttacattctttcccctttttaaaattaggttatttgctattttactattgagctgtatgaatctcttacatgttttggatatgaaccccttacacgtacatggtttgcaaacgttttctcccaatccattaactgcccttttcttttgttgattgtttattttgctatgcggaagtaacttaatatgatatagtctcatttcttaattttggttttgttgcctgagcttttgctgtgatacccaaaaaaattatttcccaggtttatatcagagagcttttccttatattttcatctaagagtttttcagtttgaggtcttgtgtttaggtctttaattcattttaagttgatctttgtgaatggtgtaagataatgggcattttcatttcttttcatgttgacattcagttttcccaccaccatttatggaagagactatccattccctattgtgtcctcttggtggccttgtggaaaataacttactatatgtgcttgagtttatttctgaagctctcttttcggttctattggtctatgtgttttaatgccagtatcataatatttaattactctggttttgtaatataatttgaaatcagaaagtgatatgtttccaactttgtttttctttctgaagattgttgtggctatttagagtcttgtggttctattcaaattttaatattgttttttctatttctatgaaaaatatctttggaattttaatagggattatgttgaatctgcagagctctttgggtagtatggatagtttgacagtattaattcttcaatccattaacacagaactttccatttatttgtgccttcttcagtttctttaatcaatattttatagtttttattgctcagatattttactttcttggttaaatttattcctcagtagtttattctttttgatgacaatataaatggaatgttttcttaattgtgtatctaatagaccattgttgatacaaagaaatgcaactgatcttaccatgttgattttgtaccctactactttactgaatttatttgttctaacaggttgtgtgtgtgtgtgtgtgtgtgtgtgtgtgtgtgtgtgtgtgtagccttatagggtattttacatgtataatcattcagtctataagcagttataattttattcttccttttcaattttgatacctttaatttctttttcttgtctgattgctcctgctagtactatcagtactatgtttaacagaagcagagagagtagaaatccttacattgtaccatatattagaggcaaagctttcagttttttcccattgattatgatattggttttgggcttttcataaatgacctttattatgttcaagaaatttccttctgtacctgtttctttaatattaaaaaaaatcatgaacagatactgaactttgtcaaatgcttttactgtatctttgacttgatcctgtggtttttatctttcatccttttaatgtgttgtgtcacatatattgatttgtgtatgttaaagcaaacttgcttcccaagaataaatttcacttagtcatggtgaataatctttttgttgtgttgttgtatttagtttgcgagttttttgttgaagatgtttgcatgtatgtttagcagcaatattggcccatagttttcttttctcgtgatgtctctgtcagctttgatgtcagggtgatactagcttcataagatgagtttggaagtattccctctattttcattttttggaggtgtttaagaattacggatattaattcttcttttaataatttgcagaattctgctgtaaattcatctgatcctaggcttttgttgctgttaggaggattttgattaccacttcaatcactttttctgtcattggtcttttcaggctatttcttctctgttcagtctttatatgttgcatgtttccaggaatttatttcctctagattatccaatttcttggcatgtaattgttcataatattctttatgatccttttttatttctgaggtatcccttataatgtttcctctttcatatctaattttaatgtcatcttctctctttcttcttctagctaagggtttattggttttgtttatattttcaaaaaaattttagttttgttaatatttcctatagtttttctcttttctgtttgattcctatgctggtctttattagtttcttcattctgctaatttttgattcagtttgttctttttctagtttcttgaggtgaggtatgttgtttgagatctttcttctgttttaatgtagacatttttcactttaagctttcttgttagattgcttttgctgcatcctataagttttcttacgttgtatttccattttcatttctctcaagatagtttttgatttttttcttgatctcatttccaaagcatttggtttcattttcacatatttgtgaactttcccatttttctactcttattgatttctattttcataccattgttgtcagaaaagattcttgatatgattttgatcttcttaaatttgttaagaattgttttgtggtctaacgtgatctatcctagagactattacatgtgcacttaagaggaatgtgtattctattactgttgaatagaatgttctatatatgttgattaggtctaaggtacagcttaaatttaatgttcctttattgaattttcatctggatgatctatccattattgaaagtgtagtatcaaagttctctatcattattgctgtctatttctctctttagttgttaatgtttgctttatatgtttatattctctgatctaagatgcatatatatgtataattattatgtcgtcttgatagaataatctctttctcattatgttgaccttctaaaattatattgactttctgtgattatcgttgaccttctttgtcacttgttacagtttgtgacttagaacctattgtcagatattagcttagcttccctgctttcttttggtttccatttgcatgaaatgtctttttccatcccttcactttcagccaatgtgtgttcttgaatcaaaagtgagtatcttatagatgaatatagttgaatcttggatttttaaaattcatttagccagcctatatctttttattgggtagcttaaaccatttatatttaaagtgataattaacaaagaatgagttactattgccattttgttaactgttttctttttgtgttgtggttcttttgttcctctttttcttgcttcctgcctcttttttattgtttgtattgctagattttaattgctgttcctttttcttttgtgtaacttgtataggtattttctttgtggttatcaaggggcttaaatatctaatagttataacagtctctgcttagctgataacagcttaacttcacttgcatgccagaattcactgcttttacctttcctctcctcacattatacactgctgatgtcacaatttacaacttcttatattgcagaaccattcacacaatttagttatagttgtatttgaaacttttctcttttaccttttatagcaaattaccatgtatctatctaccactcttacagtaatacaatattctttctgttcctatatgtttacctttgctaatgagtttcatacttggtgttcattcatgttgctgtttggcatcctgctgtttcaacttcagtgacttcctacagcatttctcataagaaatgtctagtggtgataaacttcctcagcttttgtatgtctgtagaagtctttatcttccctttgtttttgaaaggctggtttgctgggtatagatggcaatttgtttcttttagcattttgaatatatttttctgcccccttctggcctgtaatgtttctactgaaaaatcaactgatagtctgatggcatttcctgagtaacaagcctttttttctcactgctttcaaaattctctcggtctttaacttttgtcaaatcaattacaatgtgtttcagtgtggaactctttggattcatattatttgatgtacctgaggtttgctgaatctggatttctgttttctttcccaggtttggaaagtgttcagccattatttctttaaatactctttttgtccctttttcttttttttctctttctcatcctcctataatgtatgtaattgttacccataagtcccataaagctgtcttcagtctttttcattattttttctacttagattaatttctaatgacctgtcttcagttttgctgatcaatagagtcctctattgattttttcaattcagtcattgtaatcttcaactctatgatttctgtttgatgcattttaatattttctatcattttgttgaaattctcagcttgtcatgcattgtttccctgaccgtggtgtgaacacccatatgactgtttctttgaattttctcttgggtaaatcacacagctttatttcactaaggctggtttctggagatttatcttggttttttattcggagcatatttctttgtttcctgacttttattgacactctgtgttggtttctgcacagtctgtaagacaactgtctctccctgtgttatcagactagtgtcttttaagaaatgtacctcactaatcaattcagcaagagattctaggtgccccaacttttatgcttatcttaatctcttttttttcagtgatccccaattagtatgtgccaagttttgtcagtgccccaagacagacaagatagaagccagtcccttgagatgcatctggaaaatttggcatgttagatatgtattgtcagggagaagctgaggatgggagtttacctcttactcaatctgcactaagccaggaagaggatctgtgggaaattcctgcactctcatttgaactacacactctgatctagatgcatagttattggaagtgcacccattcaaaaatcacatgcattaaaactcatagaaatgtaaaaattaaatattaaaagtctagtttgatatatgtaaattaaaatatatatgtgcatatgtataataatttcaaactattgtaaaaagatatagctaaagtagtggataataatcagatataagtcaggagagagattgatccaaggtaaacaggtcttccattcttacaaagttcggaagatatgtaaagaaaccatcgacactaaacttttttttttattatactttaagttttagggtacatgtgcacaatgtgcaggttagttacatatgtatacatgtgccatgctggtgcactgcacccactaactcgtcatctagcattaggtatacctcccattgctatccctcccccctccccccaccccacaacaggccccagagtgtgatgttccccttcctgtgtccatgtgatctcattgttcaattcccacctatgagtgagaatatgcggtgtttggttttttgttcttgcgatagtttactgagaatgatgatttccaatttcatccatatccctacaaaggacatgaactcatcattttttatggctgcatagtattccatggtgtatgtgtgccacattttcttaatccagtctatcattgttgggcatttgggttggttccaagtctttgctattgtaaatagtgccgcagtaaacatacgtgtgcacgtgtctttatagcagcatgatttatagtcctttgggtatatacccagtaatgggatgactgggtcaaatggtatttctagttctagatccctgaggaatcgccacactgacttccacaatggttgaactagtttacagtcccaccaacagtgtaaaagtgttcctatttctccacatcctctccagcacctgttgtttcctgactttttaatgattgccattctaactggtgtgagatggtatctcattgtggttttgatttgcatttctctgatggccagtgatggtgagcattttttcatgtgttttttggctgcataaatgtcttcttttgagaagtgtctcttcatgtccttcgcccactttttgatgggtttgtttgtttttttcttgtaaatttgtttgagttcattgtagattctggatattagccctttgtcagatgagtaggttgtgaaaattttctcccattttgtaggctgcctgttcactctgatggtagtttcttttgctgtgcagaagctcttgagtttaattagatcccatttgtcaattttggcttttgttgccattgcttttggtgttttagacatgaagtccttgcccatgcctatgtcctgaatggtaaagcctaggttttcttctagagtttttatggttttaggtctaacgtttaagtctttaatccatcttgaattgatttttgtataaggtgtaaggaagggatccagtttcagctttctacatatggctagccagttttcccagcaccatttattaaatagggaatcctttccccattgctcgtttttctcaggtttgtcaaagatcagatagttgtacatatgtggcattatttctgagggctctgttctgttccattgatctatatctctgttttggtaccagtaccatgctgttttggttactgtatcctggtagtatagtttgaagtcaggtagtgtgatgcctccagctttgttcttttggcttaggattgacttggcgatgcgggctcttttttggttccatatgaactttaaggtagttttttccaattctgtgaagaaagtcattggtagcttgatggggatggcattgaatctatctgtaaattaccttgggcagtatggccattttcacgatattgattcttcctacccatgagcatggaatgttcttccatttgtttgtatcctcttttatttccttgagcagtggtttgtagttctccttgaagagatccgtcacatcccttgtaagttggattcctgggtattttattctctttgaagcaattgtgaatgggagttcactcatgatttggctttctgtttgtctgttgttgatgtataagaatgcttgtgatttttgtacattgattttgtatcctgaaacttcgctgaagttgcttatcagtttaaggagattttgggctgagacaatggggttttctagatatacaatcatgtcatctgcaaacggggacaatttgacttcctcttttcctaattgaataccctttatttccttctcctgtctaattgccctggccagaacttccaacactatgttgaataggagtggtgagagagggcatccctgtcttgtgccagttttcaaagggaatgcttccagtttttgcccattcagtatgatattggctgtgggtttgtcatagacagctcttattattttgagatacgtcccatcaatacctaatttattgagagtttttagcatgaagcattgttgaattttgtcaaaggcctttgctgcttctattgagatagtcatgtggtttttgtctttggttctgtttatatgctggattacatttattgatttgcgtgtattcaaccagccttgcatcccaggtatgaagcccactcgatcatggtggataagctttttgatgtgctgctggattcggtttgccagtattttattgaggatttttgcatcaatgttcatcaaggatattggtctaaaattctcttttttggttgtgtctctgcccggctttggtatcaggatgatgctggcctcataacgagttagggaggattccctctttttctattgattggaatagtttcagaaggaatggtaccagttcctccttgtacctctggtagaattcggctgtgaatccatctggtcctagactctttttggttggtaagctattgattattgccacaatttcagatggtgttattggtctattcagagattcaacttcttcttggtttagtcttgggagagtgtatgtatcgaggaatttatccatttcttctagattttctagtttatttgcatagaggtgtttgtagtattctctgatggtagtttgtatttctctgggatcggtggtgatatctcctttatcattttttattgcgtctatttgattcttctctctttttttctttattagtcttgctagctgtctatgaattttgttgatcctttcaaaaaaccagctcctggattcattaattttttgaaagctttttgtgtctctatttccttcagttttgctctgactttagttatttcttgccttctgctaggttttgaatgtgtttgctcttgcttttctagttcttttaattgtgatgttagggtgtcaattttggatctttcctgcttcctcttgtgggcatttagtgctataaatttccctctacacactgctttgaatgcgtcccagagattctggtatgttgtgtctttgttctcgttggtttcaaaaaacatctttatttctgccttcatttcgttatgtacccagtagtcattcaggagcaggttgttcagtttccatgtagttgagcggttttgagtgagtttcttaatcctgagttctagtttgattgcactgtggtctgagagatagtttgttataatttctgttcttttacatttgctgaggagagctttacttccaagtatgtggtcaattttggaataggtgtggtgtggtgctgaaaaaaacgtatattctgttgatttggggtggagagttctgtagatgtctattaggtctgcttggtgcagagctgagttcaattcctgggtatccttgttgactttctgtctcgttgatctttctaatattgacagtggggtgttaaagtctcccattattaatgtgtgggagtctaagtctctttgtaggtcactcaggacttgctttatgaatctgcgtgctcctgtattgggtgcatatatatttaggatagttagctcttcttgttgaattgatccctttaccattatgtaatggccttctttgtctcttttgatctttgttgatttaaagtctgttttaacagagactaggattgcaacccctgtctttttttgttttccatttgcttggtagatcttccttcctccatccttttattttgagcctatgtgtgtctctgcacgtgagatgggtttcctgaatacagcacactgatgggtcttgactctttatccagtttgccagtctgtgtcttttaattggaggatttagtccatttacgtttaaagttaatattgttaggtgtgaatttgatcctgtcattatgatattagctggttattttgctggttagttgatgcagtttcttcctagtctcgatggtctttacattttggcatgattttgcagcggctggtaccggttgttcctttccatgtttagcgcttccttcaggagctcttttagggcaggcctggtggtgacaaaatctctcagcatttgcttgtctgtaaagtattttatttctccttcacttatgaagcttagtttggctggatatgaaattctgggttgaaaattcttttctttaagaatgttgaacattggcccccactatcttctggcttgtagagtttctgccgagagatccgctgttagtctgatgggcttccctttgagggcaacccgacctttctctctggctgcccttaacattttttccttcatttcaactttggtgaatctgacaattatgtgtcttggagttgctcttctcgaggagtatctttgtggcgttctctgtatttcctgaatctgaacgttggcctgccttgctagattggggaagttctcctggataatatcctgcagagtgttttccaacttggttccattctccccgtcactttcaggtacaccaatcagacgtggatttggtcttttcagatagtcccatatttcttggaggctttgttcgtttctttttattcttttttctctaaacttcctttctcacttcatttcattcatttcgtcttccatcactgataccctttcttccagttgttcgcatcggctcctgaggcttctgcattcttcacgtagttctcgagccttggttttcagctccatcagctcctttaagcacttctctgtattggttattctagttatacattcttctaaatttttttcagagttttcaacttctttgcctttggtttgaatgtcctcccatatctcagagtaatttgatcgtctgaagccttcttctctcagctcgtcaaagtcattctccgtccagctttgttccattgctggtgaggaactgcattcctttggaggaggagaggcgctctgctttttagagtttccagtttttctgctctgttttttccgcatctttgtggttttatctacttttggtctatgatgatggtaatgtacagatgggtttttggtgtggatgtcctttctgtttgttagttttccttctaacagacaggaccctcagctgcagctctgttggaatacctggccgtgtgaggtgtcagtctgcccctactggggggtgcctcccagttaggctgctcgggggtcaggggtcagggattcacttgaggaggcagtctgcccgttctcagatctccagctgcgtactgggagaaccactgctctcttcaaagctgtcagacagggacatttaaatctgcagaggttactgctgtctttttgtttgtctgtgccctgcccccagaggtggagcctacagagacaggcagccctccttgagctgtggtgggctccacccagttcagttggagctccctggctgctttgtttacctgaccaagccttggcaatggcgggcgcccctcccccagcctcgctgccgccttgcagtttgatctcagactgctgtgctagcaatcagtgagactccgtgggcataggaccctcccagccaggtgcggaatataatctcgtggtgtgccgttgttttagcccgtcggaaaagcgcagtattcaggtgggagtgacccgattttccaggtgccatctgtcacccctttcttcgactaggaaagggaactccctgaccccttgcgcttcccgagtgaggcaatgcctcgcccgcttcggctcgcgcatggtgcgtgcacccactgacctgcacccactgtctggcactccctagtgagatgaacctggtacctcagatggaaatgcagaaatcacccgtcttctgcctcactctcactgggagctgtagaccagagctgttcctattcggccatcttggcttctcctcccaacaagttcttttgacactaaacttttaaagtagatgtaaaaatatccattttaactattaaaataacaaagtttatcttccaaaccagtagagaaaacaaatagaacagaagtagtaatggagaaaggagaggagaggagtttattaattcaaattaaatgaaaaaaaggagaaagaaataagaaatgaaaatcaaattcaagtataatagtaaacatgataaatgcaaatggttcaaattcactaggttacacagggattatcagactggataataaatggaagttttcctttcttttttactaaaacacccctaaaacatgaagagacagtactgttgaaaatgaaaggatggaaaatgttaaacctgatatgtagcatcagtttggctctccggaatcattctagactgtcctcccttctcatccctctctcacccccaactctcacctcagctctatgccatggatggtgatttatgtatggactacataaatgagcctcttttgctgtgcagcttctgatggtctcaacctgtgggggacacaatctggagcttagagtgttggcagatagagaggtcagagcattgttctcctaagttccttcctgagagaccatagaatggcaatatgtgtgttcctctgtcaaaagccaaaactttagtaagatggccttccacagtattctgtggcctaggaagatttatgaatgcagagttctttctgctttcaaagctaagtgttttaagaaccaaaccctttgggaggaacaacaaaaattggggtgctttatgtgtggtctaagccctttgctactcatggaaaagctgggagtttggggttccttcccagtcattaggtgctgtccccaggtagggtttgtgtgtgagtgtgtcccagattttcctacccgtgttggtgtgggtatattcttattttcccagtgtgtacaagtctctcaactagtttctggttttctccaagagggattgatcaatgtgtagctgtttatttagtgcatctatggaaggagggaaaatcaagagcttcctattcttccatcttgcagatattaccactgcaaatgtccttgggacagaatggtagatataaaacaagtataagtaatttccttgcagtttttgcattttccatgtttagcattcttttcaaaggattagattgtgaattttcagtgctaaataagttatgactaacattccagctggtaatatattgatcagtagtggttgtgagaatggcaaatagataagacatagagatatgataagaaatataataaaaatgcatacctcaatggtttgtgatggtagatactggaaagaagaataatttaagatataattagactttgactataacgtattcagatatttttgaatattattaacaaacttatgatctgtaaaacattaacttctgccagtaattccagagaattatgtgcaatggttattagttgcataaagctggaggaatatttaaatgatctacttaaaattaattactctttgatcaataatcttggtcaaaaagagggcttcctatatcagtatggaaaatattatatttattcacattattttacaattatccttcctttttcattggattctcatttacttaatgaagaaaacacattaaattgttataggaactatatttcagtatctgttcctttgacagtaattgtattagagttccagacctcacacagcttaaattctcattgtacaaagtctactttcaaatgctttcaaaaagacaaaatttccctctcccccttattatttgagtgtaggatgatatattttcttggcctagatcatgatacatacttatgtctgtctttttagcaataatttttaacaaaaatttagcaaatctcattaattttgattgtaactttgaattatattgctttgatctaaaattatttatataacacataatttttcccaaaagtcttttggatcaaaaatgtcaaattgagtattaacgaaagattactctgttagtcttccacaagaaagatcaggagcccatcatggttagtaccagttttgtcagacagttccattgatgagaggccatcttcattgctcttctttattattttctgtgtaaaaccgaattctatctgacacagctttgtgttggttgtctgtaagttagctttaatatagcagtttgctttagcattgtcagattcacaatgtaaaatatactgtggcaaaataatacaatgttgtgttagttaaattaaaagcattgactcctccagccttaagaataaatctgaattgtagagcctgatcgttaaaagataatgatcatatactgccataggccacagaaatttaaaaggtcttagtgcttctttcagatagagatgcagagactaatttgaaatgaatacatagcctaacaagatgagtaggtttatttaagcacatgactgacttttgttcttcatgttgaagaggcttgaatctttagtgtcaccctgtttttaataatgatcttaaaagttcttttctttggcagtttgctttctttctgtgtattaacctttggttgtctaattattgtttcctttggtacatatttaatattttctgcttgtgctctttattatttgtgttctagatccattgcttgcccagtaagtaaatacatgaagaaaatatactaatactgtggagtagaggaagggaagaggaatatttatgaatattaatgaatattaataaaatctactacagtctattttatcatacatacttcccttccttttgtatataaaatatagtcacttcccacctgcctcctccaggaagaaactcaaaagtctcatctaattgtctaatcttaatagccttgaagtaaaaatgcaaattatctggctccccactcaccacattcaacattcaatgaggaaacagaacaagataatcataataaacacttccattgcaaatagaaagatggacacatatagtagtccctgaatactagcatttctgaactcctgttgatcagaggtttcaccatccctcttcctgtgtgagtggcaaatctttgctgaggttttctgggaacaactccctagttattgttcatgactcttggctctggcctctggcaaatccttctgtttcaatgatctcacttcgttatatctgaacagggcatttgagaatccgtcttttttggatctgagcactgagtctgaaactatgaaaggttctaggtaccactgtactagcacgtacaagatatgcatgtatacgtgtatatattaatacatacgtgtatacacactaacatgtgagtacacatacacaaaaatgcacacacacatagtagcaatatcttgagatctctggtttggagatagactctttactcacatagtaacctgtgtcacttccctatacctcaatttcccacaagataacatagtatcagatatatcctgcacagaaaatggggtttatgacacaggagagttactccaaaattatgaatcttggggcttatatagggtaattggcacatgtggcccttctgccctctggagactagagagggaagcttctctagaatgtaagcaaatcctctcggagaagatggagaggtctctacttcaccactctggaatgtaaataaaactctctgagggagatgtccataaattttcttggaaatttctatctttatcatacaagacttatttgatattcaatcatttttaacccatgttacttggaatttttgttcaggaagctctgaccatgcagaaacatgaaatattcgtggagcattgtctcctgacattgtgtagctttctcaacctttcttctacctataactttggtccaaagaaggtccaaaacgcgtatatactttggtgggaatctcacttatttcagccacatggaaagcagctgattactcaaagaacttacaactaccatttgatgattgggtatatatcccattactgcacatgtatccaaaagaaaataaattgttctaccaaaaagacacgtgcactcttattttcatcacagtactattcacaatagcaaagacatggtgtcaacctaggtgcccattgaaattggagtagttaaagaaaatgtagtacatgtacaacatggaatactatgcagccataaaagagaaaaaatcatgccctgtgcagcagcatgtatgtagctggtggccattttcctaagctaattagcacaggaacagaaaacaaatactggatggtctcacttctaagtgggagctaaacatttgatacacaaggtcgtaaagatggcaacggtaggtactggggactactaggggtggagtgagggatggagaggcaggatttgaaaaactattgggtactgtgctcactacctggatgatgggatcagtataccccaaaccttagcattgtgcaatatacccatataacaatcctgcacgtgtacctcctgtagagatctaaaagttgaaacaaacaagagatcgccagtgatggtgtttcttgaaatataattcatacaccatacattttatccatttagtgtatgattcagcagcttttactatagtcacaaaattctacaactctacaactgtcactccagttttagaacattttcatcatcctaaaaagaaacaacataaccattagcagacccacgcagctctaccttactccaccccgctaagtcctaggtagccacctctactttttgcctccatgagtttgcctattctggacatttcatgtaagtgaactcatataatatgtggtcctttatgactagcgtcattcacttggtgtaatattttcaacattcatccatgtacattttattgccaaataatactagaaatcatctgttttatttctctagcaatcagtttctatttatccaggatggtggcacttttaacagcagagcttcctcaaaacataattgcttttgttgttgaaactctatatatttgattatagtcagctacatgtgcctacttacaattctttttagggaatgtcagttcctgattctctgtttctctctgtccctctttcttatctaactatctgtctgtctgtctatctgtctatctatctatctatctagcttagtccattttgtgtcactataaccacagactgggtaatttgtaatgagtagaaatgtatttcttagagttctggagcctgaaaagttcaaggttgaggggcatgcatctagcaagggctttattgctgcatcatcccatggcagaaggcagaagggcaaaagaatgcaagagtaagggagccagaaggggctgaacttccttttataataagcccattctcatggcaactagcccactcccttgatatgaacatcaatccatttatggggtcagggacctcatgacgtaatcaccacaaaagatgctaaatagccaaagcaatcttgagcaaaaagagcaaagccgaggtatctcacatcctaatcccaaaatctatacaaaactacaataattaaaacagcatggtattggcacaaaagcagaaatatagaccaatggaacagaataaagatcccagaagtaaatctgcacatttatggctaactgatctttggcaaaggtgacaagaacacacaatgggggaaaggacagtctcttcactagttgatgctgagaaaactgtatgcccacatggagaagaatgaaactggactcttattttatcactttaccacaaatgcctacacttatatgtatgtacctcataatacattgttgagatcattgtatgtgtggaaattatagtatttttccaattaaaactatatcataaacattctcaatacatctctattttaatgatataattgaacaattgtatctaaaatttgcattgaaacaaaattggtgtagacacttccttgtaataattctgagatggttgtcaaatgggtagttttgttgtttaaattaaaattttgcttacacttattatcattatcctgttttaaaatgaaaatttaattatcttattttttctacaggtagtatacaattattttcttccaaatatatatactttatttaatctatttaaatgacccaagagagatgggttttcataccttgctagaaaataaactctaaaacatattattaggtcagtaagatttcagatatctttatatttgatctatttatatcagctgtgacataattcatatttcttttattgattcagaagaaataaaactatactttcgtatacctatgagtgatttagaattcttcttggaagagggagaaacacttagttattctttgatatccaaaagcaatagtacttcaagattctaagtactataatctatacatatatatgcatgatatcatatgtgaattctatattataaatacttaatattttatatttctcacatattacagattgtataattgatgtgtttttaagccaaaatttagcagattttatgagcttttcttttttaatctgggaaatttcatctttgctttaataaacttgctcaaggactcagaatttgagttaggtatagtgtgactatgggtgggtcttaatttgcatatcctaatgaggaactgtaggataagaaaataattcttcactaatacttgttttttgttttgttttgttttgagactgtgtctcactctttcacccaggctggagtgcagtggcgcgatcgtggctcaccgcaatctccgccttcagggttcaagtgattcttctgtatcagcctaccaagtagctgggattacagacatacacaactacctgcttaatttttgtgtttttaatggagatgaggtttcctcatgttggccaggctggtcttaaactcctgacttcaagtgatccacctgcctcagcctcccaaagtggtggaattacagatgtgagccaccatgccaggccagtaacattatttccactaaattctctaggtctctaaagagatcagcaggtggtttgtggctccaagtcaaacagagcttttagaggtacatgacatccttcttgagccttcttttcaagtctctagtcataagtttttcattagataaacattctattgaggtgtaatttgcatacagaacagtaaacaaatcagaaatatgtagcttgatgaattttcacagaatggacacttctgtgtaaccatcatccataaacattcatgtaaatcaatagaaacttgctggcaccacagaagatccactaagtctcctcccaatcacaggcctgtccaaaatgatagctgttctggcattttaattaaagtcatctatgggttactttgggtgtttgaatttttttctttccttcctcccttcctttcttccttcatattcttccttccttcccttttttcttacttctttttagctttaaaaggggtcaagtgtgagacactgatataatctatataaaattacgagttttcaactggaaaatatcaagcacacatgaattatatttctgctttgagtgtagactgccatgagatttgtaatattatatattaactagtgaaaatagttattaaaagctgttgtgctttcactttgaatttggtaatttattttccatttacatttttctgttaatatgttaaatttattaaggcagtagttaagagcttaattgttgtgcaaaaagaaaaacagggattttcatttccttgtttgctcttttattacactcccacttacttggagtggctggatctatttattatcttttccttttaagatctgagtgcacaataatatttgattcatttgagtctttttatacatgaaaatagcaatatggcagttgctcagttttttatatttatgactcagtattttatggattgattattattcacttgaaatgttacaatttggtctcaatttgaaaaggttagaattaattataatgaagcattagcgattaatcattagaacttaaaatcaaaatgtcagtatatttattgtgaaattgcttgaattggctgagaatttcactaatatatcagacaatcaccagtcctaactacttcatctcaagtcaaaagataacagcttttaaaggtttgttccaagttttcatctctgtggttttgtaactagaaaacaggtatgagctatagtaagtgttattcgtaaaagttacataatggtttgtatgtatattgtgttggtgttcggaaatgtgacgcccaaattatgtcattattcttttttttgagactgagttttgctcttgtcacccaagcagcagcgcaatgacatgatcttggctcactgcaacctccgcctcctgggttcaagcgattctcctgcctcagcctcctgagtagctgggattacaggcacctgccaccacacccagctaatttttgtacttttagtagatgcagggtttcaccatgttgtcaaggctggtcttgagctcccaacctcaagggatccacctgccttggcctcccaaagtgctgggattacaggcatgagccaccacgcccggcccgtcattattctcatttgaatcagttggtataaattatcatttaaataaatatatgactacatacaattttcaacttatggtaaacacaatgacattcatggattatcatgaagaagttaaagtagtcacaaatggaaaggaagatctttgtgcttttatcttagcaatttcacctgacatcttacagtagggaaaatgggcaaatgtcagtgagctgaagggcgtgtttagttggaactggctaaaaggtagagctaggacagtattggaaacccgtgacagtgagagtaattgacatttaacatgatagactatgggaagtttgtatgtagaaatatactttgttaagccttaaggtaatatgagagtattacttattgttataaatccatttatttttaagaatattagtttaagaatattattattcataaatgtgagacatcaatctttatcaaataggactagttattggtatcctaaaatcaagtgaaatttattgttactacaataattgatttataatgttacatttatttcctatttattttggttgccaataagtatgaacaacaaaaaaggttaaaaaaaatccttcactgtattgttaatttcctttggtattcacagctcacatctaacaaaatatttcagtcctaaatgagtttcttctagtttaaatagtctagtaaaacattttgattatatttactccaaaggatacatcattaaattattttaaatgtaaggtaataatttttctctatgtttactaaaattttttcctcagtagacgaatggttaccaaaatgatttgaggctctagtgaatcatgtaagttccataacacaaatattcatatgtaaatttaaaaactagttcaaattataatttattcataattacacaaaattattgttttatgaaaggttgagaaatgaagtaaatgtaatatacagtaatgtctatctatgtacctgcttatctatgttgatgacacaattttagaaaattgtatttttagatttactaaatatttatctgttgtgtgaattaaaatggcaatcgaatacaaatgtgggttaataatgatgaaatttcaattacaaaatatgagaaaaaactttgtaaacattacatgaaacaattcatttatgggagcttttttttttttttttttttggagacagagtcacactcttgtcacccaggctggcgtgcagtgtggggatctcagctcactgcaacctccgcatcctgggtcaagcaattctccattacaggcgcccactaccacgctcagctaatttttgtattttttagtagagatggggtttcaccatgttggccagactggacctcaggcgatctgcccacctcggcctcctaaagtgctgggattacaggcgtgagccaccgcgccgggcctctatgtgaactctttaaatttagacattttcaacaacattgctgttcatttctgtagtagattaaggtgtgttcatataactgaacttctaaactcgtgatatatagattatttttggcctaaacagtgttttaaaaatttaaaaagcttcacatacaaatccaggtatttagctgctattgaaagattgtaagacataagagcaatagacctaatttgaacatggtaagttaactagaggtgaatagttatataactgttgcatggtaggtgaggaaggaagaaatggggaagcaggctgaaagcaagcccaggcaagcgataaaacaatagcatcagcatattaacagcaatattcctttattcagtatagcagctctcagactgtttggtgtgagcatataactatagatatttactactttagaaatatagaaatttaaattgataaattgagaaatttactactttggaaatttaaattgagaacattttacattatttatttaaaaaaattatttatttatttatttatttatttattttgagacggaatctcgttctgtcgccctggctggggtgcagaggcgtgatctcggctcactgcaacctccgcctcccaggttgaagcaattctcctgcctcagcctcctgagtagccaggactacaggcacacaccaccacgcctggctaatttttgcatttttagtagagacggggtttcaccatgttgggcaggatggtctcaatctgctgaccttgtgatccacctgcctcagcctctcaaagtaaaaattatttttaaaataatgaaaaacccattcctattataataaataacatattctttataaaagtaactatgtcttttaaaaagtgagaagagtggctttgtttcactcttaataagtttctttaatacctgactcaatagaagtcagctaaattctcatacctgattcccatatttaatctgttttaatatgttcatcaggttgaggtgtataaagaaaatccagcctcacacagaaacatagttagaaaagagaggagtattttttaagtttttgcacgtagttgtgaatattttctgttatactttattgaaagttgacaactggtaatttcttgaagttggtttaaatatttttttacccatgcaagatttgctagcatcatgcattggtcctctggaaaatgttgattcactgagttatgcaggtcttctgaatattgacccatttcattttgtaataccaagaaatcaccaccaatataataagaacaagcttaaagtactgtattggaaagctatcaggctcacagtgtactataaaatttttcccaaactatgatttttgctttaccctcctattttatcattgccaacaaatacagtcagttattttccttcaagtgacagagttttttcatttttgtgaaaatatctgtaaaatatctaatgtgaatggtttgtgtgtcacttgtgctttcaacttaaaatggtgcttcatgaaaaaggcagctaaatgagcatgcaactcagtctcataagtgcatttccaggagacagttaattagttacagaaatgctgtatttgtacttcccatttgttatacttgagtcaagatttaataaaattaataattttactgatgcatcaaggatatttttaagtaaagtaaacccggattttttttgttattctacaagggcttggcagtgaaaaattcagtgactactagtagtttgctaacactgctttgatttgtgctaaggttccagcagttttacctatcattgctttttcaccatcactgcaaacatcagcactgtgcaaaaggcaaatggaaatttggaatgactaacaaaatagttttgacttagttgtatcctcaaaaagatgctttagaactcccaaacacccactgtctacactacgaaaactgtcactctataacaatgtgctaacttaaaaaatcaatattataaaaatataacatatacaataacgcaactgattttaactgtacagcttaatgaatttggacaaatgtatgtatccagttaaccaccaacacaatcaagataaagaacatttccataatctcaaaaggttccctcatgacccttttcattcactcctcactcccatctccaccccaggcaaccatgcgtgtgctttctatcactaaggattttattttgtctttcccagagtttcatttaaatagaattatgcagcatgtgtgtgtgtttttttcctgtcttccttctttgacccatcttaacaatgttgagatatatcagtaattttatgtattataccacttcgttcattgatttcaccaagttctattccaaaactgttatgaatgtttgtttagaagcttttgtgaaatttaaaaaaatttaacttgagtaaatgcctaatagtacaatttctggattttactgtaaatatgtttgattttattagaaaatgccaaaccctcttccaaaaggattgtataataccacatttcacctattccatgtgagagttccagtttctccgcatccttgccagcatgtagtattattggtatttttcattgtaactattctagtagttttactctagtacctcatagttataattttcagtttttgttggctaatggtattgaatatcttttcatctgtttctcttttgtcatgtgtgtcttcaattttttgctcatttttaaaattgacaaagtattcttattattgagatgtaaacggttcttatataatatgttctgggttataaatcctttgtcagttttatgcaatgcaagtattttccccaggtctataagcttgctttgtatatttttactacctttcaaagtgcaggtgttttaattttgatgaatttgataaaattttattctgcggtttgtgttttctttgttctacttaaggaaacgtccatttgatggttacaaaaatgtttctcccatttttttctaaatatttatggttttagcttttttatttgagtctatgattagttcaagttaatttcagagtctgatgtaaagtaaggattgaggttttttattttcttttttttttttttttttgccctgtatggatgtccacattttctagaaccattgtcgaaaacattatcctttccgcattgcatttcttacaatctgctctttttctgcttttgtagcatctcacaattttgatatgttgcattttcatttttttcatttcaaaataagttatatttgcccttttaatttcttctttggctcatgacttacttaaaagtattttgtataatttccaaatatttgacattgtttccaaatatatttctgcttttgaattctaattagttctgtattagacctcatatgtagaccacatacgtagaccatatacatatcattgtagtgctattggaaacttgttttatggctcagaatatgatctacattcatgcatgtcctatatatgttagaaaaaatcgtaattattgggttaattattgtaatgtcaattagattagacaatgtttgcttgtagtttcatgtcttctatattccggcttatgttctgtctgcttattctataatgtgacaaagagaagtgttgaaatatccatctataattgtggatgtatctattgctcctttcagttttgtcagttttgcttcatgtactttgaagttttgctattgcttgcatgcagttttaggattggtatgacttgttcatgatttaacatattattatgaatatccctttttattcgtagtattaactcatgttctggtctatttttatgatattaatggagccaactagctttttatgcttaatatttgcacaacatatcatttttctttctttctaacttgtctgcttatttaatttaaaagtagtttcttatagacagcatatagttgtaactctttcgttattccagcacagtaatttcttcctgcatttctaattgcagtgtttagactacatatttttaatgtaattatctatactatgtgtctcccatctggatttttcctctatattttcattgttcactttttcctcatttccccccttttttcaggctaattgagtactttttggatttttttttttttactattttcttactagatctacttttctttttgacaatggctctagagtttacaatatgcattttgaacttattgaagtaaaaggaggcctggcacagtggctcacgcctgtaaccctagcactttgggagcctgaggcaggtggctcaactaaggtcaggagttcgagaccagcctggccaacatggcaaaaccctgtctctactacagatgcaaaaattagctgggcatggtggtgggcacctataatcccacctacttgggaggctgaggcaggagaatctcttgaaccctggggtcagaggttgcagtgagccgagatcatgccacttcactccagcctgtgcaaaagagcaaaattcagtctcaaataagtaaataaagtaaaaggaaaactgtttctttactcacaatacttctgacactaaatgtttgggatttttttgtttacacacacaaaaaaactctctggacaccaacttagtgtcttatatgcttactcaattctgacactgactattcagaattagtgtcagacgctacaaggttagaggctccgtcctacaggcctgcccctcacttgaaatagcaatcatggccgggcgcagtggctcatgcctgtaatccaaacactttgggaggccaaggtgggtggatcacaagatcaggagatcgagaccatcctggctaacacggtgaaaccccgtctctactaaatatacaaaaaattagccgggcgtggtggcaggcacctgtagtcacagctactgaggtaggagaatggggtgaacccaggaggcgaagtttgcagtgagcagagatcgcgccactgcactccagactgggtgacagagcgagactccgtctcaaaaaaaaaaaaaacattgcaatcacaagtccagtcccaaatggctgataatttgctagaatgactcacataactcagggatacactttatttaaatttactggtttattataaggaatgttaaaacagatacaaatgaacagccagatgaagaggtacgtagggcaaggtctgaaaagttcctgagtagcttctgtctccatgtagtgggggtatgccactctcccagcacgtggatgttcaccaacctggaagctctttaaactgcagttttgagatttaatggacgtttcatttcataggcataatgaattaactcaatctccagccctgttcccctccctggaggacaggggataggactgaaaattccaagctaatgataaattagtctttctcatgaccagccctcctgaagttatccaaaagcccaccaagaattgcttcattagaacaaaagatgctaatatcgcctgggaaataccaagggatttaggggctttacattaagagactcctgtcatcccatcaatcaggaaattataagggttttagaaactgttttaggagctagagccagagaccaaacattagagcagacgatgctcctagtacccatatcacttaaaaaattacaagagttttatgggggcagatacatatttattattatatcacaacagtctaccctcataaaattttaagaaacttataatttatttccatttcaatgtataaaacttctgacaatttatttcttatactattgtgtcatacatttaacttatacatattttataagcatcatcataagcaggcatcaaatctcattcaagtgaaattttgagatgaaaaagttttgatatttatctaaatatttaccctatccattgctctccattgctttgtctagatttaagtttttagctagtatcattttccttactcctgaaaaagtttctttagtgttttcattagttcagataggctggcaacagattctttccacttaatatggaaaatgttttattttgcctgcagttttcaaagatatttttactgattatagaattctaggtggacctcttggaggcccttaaaaaatgtcttttctttttcatctttgtctagtttctcttgaaaaatgtctgctatcttgtatctgttcatctgcatataatgtgtcattctttcgatgtcatttctgggtctattgttttttactgacttatttttctctcattatagtcaatttcctgcttcttggcctaataaacttttatttgattcaagacattctatatttttatgttatttttgtaaatttacattactgaggatatgaatttggttgtatttttaataagcattgagttttgttctgctagacagttaagttacttgtgattaggtttaattcttttgaggcttgtttttgaactttattatgatagaacagccttgactgtccttttgtcttagaattcagcctactattaaggtatatccttttcgagttttctactgagtactctgaatgatcagcaaagactccactctagctggttggagctcaactgtcttccagccagccctttctgagctgagaaactgtgcaagtcaccagtttttggtaaccctttgtctgcctttgtgccttttaggatttggtaaaaattcaaagagatatttagagctctttttcagcatatatccatcctcttctgattgacaccctacaactcagcctctccacacttagacctcttactccttaagtcagttcccatttaggatacccttcctacatcacaggctatactatgctgcaagacagacaacaaggccaatttttgactcactttatttgtttcccttctctaaagaatcactgtgcttctctgcctattgtctaatacccggaagcaagactttcatagattttctccacttttctagttatttatggcgggaggttaaatctgatctctgttactcaattaagaccagatgtggagatcttattttgcttgattttttgtatttgcaattttctttctttgttaaatgagtacttgaaatatatgttaccaaagatatttatctcaattgtgagctttatacaggtcctaaataatagaggattgtaacattttgtattatttaaaatattaacttttaatgtaaattaacatgagggacatattagaagatggctgattatgcataacaactacttaccaaatacagattatatatatttagtgtcatttttacacagtttatacgcatacatcaatttaaatgtttttactaccgttattatctccttataataccttgactgccaaagtttttctgcatccagtgttgctatcatcttttgttcacgaggaacaatctgttctgatccctgggaattgagcaggatgtttggtttccctctccatctgatggtagtaatttgtctttcttacttacaaataatatactagatcttgatgatggaataagcttacttcttgaggaatgtgcaaacatgacaactaataatagaaatttctgtaactacagttagcatatatattttaataatacacctttgcatagattacttacatttattttcatatttatacatatgacccctaacttatgatagtttgatttccaatttttttgactttatggtgggtttatgagggaattaaatctatttcaacttacagtattttcaatttacagcaggtttattgggaaataacctcattgtaagtcaaagatcatcttgtatttcagcatattttattatacaacaatgaataattaaatagacatgtgccttttagtatgcatatacagaaatgcatcgaaaaaatatcagtgactctcattcatcaaaatattcaagccatgattgcaccactgtattcacctgggcaacagagtgcgatcagtctacaaataataataataataataataattcaatctgtttatcctatgctaagtatttccaacatttgtaatcctaattcctacagactgagttactatataacttagcttttggaaataaaaatgtgaatgagatgatctttactatatcagtaagaaagatgcatgcataatgaacaaaaaatgtggggatagggagaaaaagaagaaaattaaggatatttttatctgagtttattgtattcctatgtatcaaaagcctaagattcattttctgacattgttctgaaataaactgaaatgtattagggatgatttggattgttatttttgcaaatgtacactgttgtatattttgcaaatatttttcacatagaccctttaattgagaggcaaaagttcagatagcaattgtacacattaggctcgcatatttgattctaggaatgtacattttcagcaacacactcatagaaaaaaaatgcacagctgccaaagctgttaatgggagctgcatgctgaatttattgctacattgaaaatatatcccttcttgttcaacatattcagtcaaaaatgttcattaagaagtagtcttatctgcttttcattttcagggtataacacaagaatattatattccattaagagcaaatgtttaagtaacatttcagaaataaaataatgagtttttgcagtgctttttgggaaaatttaatttatgaaaaagaaaactcttagaatacagttgtagcatttcaatcttttcttctgtgcttgcaattattatgcaaatattattgctactgcaaaagatctttgtcatgaattgctttgtaatggggcaaggttattgagcactactttttaaagagatgtttctatgacagtattatacataagacttcaaaataaattgctaatggtaaaagactaaacaaatgcacccaccatttttatttctacagtgccagaattaaagacgtttatccaaatgctttaaatcagtttattttatattttctagccatgcctgttctagtaaacatgaacaatgattgtacacagttttcttctttagctgtcactaagatggtgtcataatgtttagagatacgctctctaactgtcagcgtttgttacagttcagtgatgcgtgataaagtatgagggacattgtcttcttgcactgctaaatgtattaatgcagtgatgatatttctcaatgactttttactcaaggtcaaaatgatgaaattcatctgtacttttcaataatttgtttattaatcaatatatttttcatcttagcctgttccttcaagttttttaggtacattttaaaatttgaagcaaatgtatattaaaatttaaagaagactgtgtcatatttttacatttaattgtattttaaattaccagccattatttttcaattcatcttttaaaataaataaaacagcatttagttattgttctttttgttgctacctatgaaaatataacttgagatagactctagaattctctgatctatttgaattctctgtttatgatctctggatataaaaattacttaaaaaatgataatcattatatgataaccattcatactatgtatttagtaattgtgtcttatttacataatcctttaaagtttacaactttaaattgcttgatttcacaagcaatagttatttttgccctaataccaattctatatggtagagactttaggaaatataaccccctttttacagttgaggaaattgagctcattgttgttagtaccctaaggtcacagatattgaacttaaatctagaattttggaccccaattccagtatcttttctttagttccattcttatttgttcatatttatagacaatctgcagattgtatatcactgacataaatattgcaatgtgttatagaataatgaagttactgataatgtaattaaatattcactgcttctggattagcatttctaaatcactattctagtgatgtaatgtcattattcacaaaacttcatggttcattgccaaccctattccttcttcgtatatggaaatcaccatcttcttccactggaaatattttctcagattagagatgccattgtttatagattttcaattactgtagttgatctaatttcacctaggagggtatatattgattataaatgtttacatgggataattacattttatcggttaaataggaaccagtatatatgctattggtttagtagcaatgcctttccaattacagcccacctttatatgatataaattgtctttattctttccccttagcatttttagagtttttaaggacatggtaatttgtattgaaagttacactactcagtggtattttccaagaagactctgcaaatcttttacattctgtgttactagcaatgtgatataaatcagttaacatccataaccgatagctactcatctacaaagagtcttaaagagtaaaacgtacaattcagaaatctgaactctggtgttaaaaaatcctcaagattattagagcaactaccatttgaaaaacagatctgaactatgaagttctgtatcagaattttgattttgaaaaatttctgtaggttaaataacaagaatcaagaacactacataccatacttttggacaaaagtttattataaccctatattataataggccaagtatatcacagtggattcattgttattactaaaagtatgcattcatagtttcagtcactttaattatcatacatggacaatgactagattttttattattaaagatatgtaaagtaaaatacataatatatcaagaatatacatcactgccactaaatagaagtgttttcattgttggaaatttaaaattatttacctattatgaaaacgttagttcttaaaaggattaggttcagcaagagtaccaacagattaaagctggacaactttggcattcctctgttttcgctgtcaaaaatacactttggactttgcaataagttcctcaatagttataaatcctagtagacaaaattgaaaaaaaaaatctcttcaagcttttgtttgctttactgtattataatggtaatagttactggggattatttttaaatttccagttgtttggatggcatgaactgattatgtgtatctaaataatatacttgtattattaatataaatattttgctaataaatatctttaaataaaatattataagttaagttgaaatgtttatctatttttatgttattaaaacgggttaacactaattcacgtgagttatggttggtgaaaattccaaattatttgttaaagatataattgtaatagagctatagagtcttcactctgtcaaaattacagagctttctccagaagcatcactgtttctttagttctcccgcaccctgctgacatgatgtggaatacactgagtatttgtcagtggagtagccaggatgggtgcagttgagagcactgctgaggagctttcaaggaaagacactctgctctgaagcaccagaagttacacccacagggaactttaccctaactcctgagttgaagtaatataggccattattataaaagaatgcttaatttagagttaaattagagttaaaaactattaaataaccgaataaatctttgtttttatgaatcactattttgtaataatcattaaaatggtgtcagtcctttaagaactcacattttatttttctatgttctgaaatatacacaaatgtattttattacacctaccctgcacaagtgtgattattttgcctgctttctcctattcatttttttttaacacagtacctgaaaatagggaaatgggcagtgtgttgtgggaggaagcaggggataaaatctcaaattttggcactggtaatatgagacagaaaggagtgaatctgagagtcaaatagttcgttacactgaggagaggtaaatggtgaaatatctggcgtccatagatccctcaacataagtggaaggaggatagatttgttcttacggtatccgtggcccactctgtacatttgggacaagtaggtttatggatgctgattttgtgagacgtgttgtttgtgagtctaatcatgtggacagaagataactgaccatagaaatggataactgacaataaaaataaatgtatttaccatgtattatgctatattctatgctgaatactttctaaaatagactttcatttttctttcaactttctaaaactttcagtttgtgagatgaataaaattattatccccattttataaatgaagcttgtagacgttatgtaactaccaagatgacaaagctagtaatggagcaaccgcaatgcaaacccagggtgtcactgttttagaaactgtgctcttaactgctacactctcatacagtctatggcctttccaaacttgcagttaaaaccaaattttagtagcaaatagaggaaatttaataaacgaatgaaagcaattgatttctttgaaaatagttttgcattgtagactgtctatgactacaaaaaaaagctttattttttctcttggtagcttatttctatagaagtgatgagtcagtgccttatcaagaattttcatttcttgcttgcacactccccaaaatggtacttgcagctatttatcattttagtcttatcagtgaattaattttggttatgattaacctttaatagagacagaatagcatggtggcttagagccagtttttcatcatgttattaaatgtcttttgagcccaattttttatctgtgaatcagggaaaataatagtacctcagttataaagttgtgcccacaataaataaattgctgtatgtagaggtctttgaacagtgcttaccttgcctaagcacacgataaatgttatttagcaattattgttaaataggattgcatgtcaaagttaaggaaaccaaagttgattctgttttattgaagttcaactaaatatcatcaacttgagttatatacttaaggaaccttcaaaatgtcggaatgaagactattttcattgtaactttaaattaataaagattaccctgaagggacaataataaatataaacattaatttgttctaaaattttaaacatgtacatgatatattacacaaatttagagtttcaaaatatgaatcttttccagccaacacagtaattttcaaaggacttttttttttactatatacctcttgataaaattagtgaaaaaacagcttaaaatggaactgattggattgaacatttgtatacctctgtgggtattgtttaattgcccgtgaaattgagttgttaaacaagcagaataatacatgtgacataaataaggtaaatcataagaaaattggaaaaataatttcgtatctaatgtgcaatccttaattataagtagtatttcgggcttacaaaatatatgcatttcctttggagagcaatttttatcttacttatctcgggttgtttagattctacttcagatattattggttggatattgtcaaaatacaacatttaaagttaaacagaggtagatatattagaaaatgtaaattgatagaatagttattttgtgtccttttaggatgatataattcagtaggtttagcataagtattaagtacacttataaattatttattaactactgtctttcaggtgtttatattctactgtgaagatatttgtagtgaggaaataaatattttttataactcatttttaattgatttaaaaagacaattttaatagttagatggtgtgatatatttccttaaatgctatcagttgtcatctaatgcatatagacataaaagtttattaatattaagatgattaatattctttgaaacataatttataatttaggataatatttcatctcaaaaaatcaaggccagtaatgtagggaattttattgacgggatgtgttaatcagagcaacctctccagtaaattttaaaatagtggatatgattttttaaaatttattaatagcatcaaagaactaaattgacaagagagatagtcattacaaggccaaaaattatgaggaagggggaattggaaaataagaagacaactgagggccagccatggtggctcacacctataattccagcacgctgggaggccgaggcaagtggatcacctgaggttaggagttcgagaccagcctggcctacatggtgaaaccccatctctactaaaaatacaaaaacttaaccgggtgttgtggcggacgcctgtaatcccagctacttgggaggctgaggcaggagaatcgcttgaacctgagaggcggaggttgcagtgagccaagattaagccattgcactccagccagggcaacaagagtgaaactccatctcaaaagaaaaaaaaaaaagacaaccgaggaagtttggcctttgttaaaactgttcgttcaacaaactcaccataataacctgttttagtgtgcaacttctttcttgccacagtgtttactaacatactgtcaacctaaataacagagagagattatctaaagatactcattctattctggagtgtgcagtatagatgctaatccaggatatgtggactatggggatcataggcatagccaaggagtttgagacaagaggaagctttcaaaggaaaaagtgaacgtaattcgttttaaaacaaacaaaatattgattacagtggcttatcacaggagttgatgccaggtccttgtggagacagtatgtcaggcaagtgttcttatgcattcactagctgtccttgtgactcatgtaacaagatgcagtttgaaaagtccttggcaaaagttctttttacaggcatatgtgcaagtaagagactttcagatgttctttgtaatagttcttatcataggcatgtgcgcatgagggccctcccttcctaacctaccagcttaatttttgacacaaatgactccatttgtggaatccaagtttgacacaaatgactccattttgatcctgacaactttcacatttcctcatttgatcaaggtctttctccaaaagcattgctgatcaaccatctcaagcatctcatagttaggttttatttctcagtgctggtatgatcttgtcctgattgttcagttcttctcacatcagtgaggatggtcagcaaattctgagtcagttttaaaaacactttagcaaaatggccgcaacaagtatgtttgaaaaccctgtatctctgattaattttgcctgaagtccattggtaagttccattttgttagttccaaaggtgttggctatcattttaacaaaaccggaccagtattattctattaggagtcttgctgttgcagatgttagacaggcaacaaagagatactgatctttatcaaacgttttgcctatgtctgttgagattatcgtgttgtttgttctttattctctgatgtgatgttccacatttagttatttgcacatgttgaaacacccctacatccctcatgtaaatcccactgtattattgcgtgtaatcttgttgatgctctgttagattcgctttgctagtatttctgttgatttttgcatctgtattcatcaggggtttttgcctatagttttcttattttgttgtattcttgtctatttttagtttcaggctaatgctagcctcataaaatgaattagaaaaaattccttcttcatcagttttttggaataattagagaagaatttatgttagttattttttaaaagtagtttagaattcagcagtgaacccatcaggtactgggtattttgttattagaagactattactggttcaatccagttactgattttatatatgtttgggttttctattttttcttggttcaatcttggtaagttttatttttcccagaatttattcattttcttgaggttttctagttggcatgtagttgttcatatttttttctaaatggtctttttgcatttctatgatatcagttataatatctcctatttcatttctgattgtttttatttgggtctccactgtttttttcttactctaactaataatttattgacttatgtttatcttttcaaacaactaggtttttgttttgctgatcttgtattatatggggttttctttttgtctgtattttgtttagttctgctctgatctttgttatttattttttatactaattttctgtttggtttcttcttgcttttttagttccttgaggtgcatcactacatcatttaattaaaatctttctacttttatgatgtaggtttctatggctataaacgtccgtcatagtactgcttttgctgtatcctgtaggttttggggcgttgttttctattttcacttgtttcaagatttttttttctctttaattccttccatgacccatcagtctttctggagcatgttgcttaatttcaatgtatttgtacaatttccagagttcttcacgttatttgtttctagttttactcctttgtgatctaagaagatatgtgatgtgattttgatttttgatttttcaatatttgttgatgcttgttttgtggcctaacatatgttccctcctggagaacatttcatatgctgaagagaagattgttttctgcagctcttggctgaaatattctgtatatgtctgttaggtttatttggtctataatgcaatttaagtctgatgattatttttgtttttctgtctagataatctgtccaatgctgaaagtagagtgttcaagtacccaactgttactatattgctgtctatattggtctttgattaatatttgctttatacatctgtgtgctccagtgcgtgtgtgtgtgtgtgcatatttacaattgtattttcttgccaaactgatctgtgtatcattatataattgccttatttgtcccttttgttcttcgacttaaaatatctattttgtctgatataagtatggtactcctgcatggttttgttttccatttgcctggaatatctttttctcatcccttcattttaagtctatgtgtgcctttagaggtgaagtgagtttcttatagccataatattgttgggtcttgtttttttttaatcaattcagcagttctgtattttttcatatgggaatttaaagtgtttacattcaaggtttttacttttctattgaaacatattcctgtcattttcttaatcattttctgattattgtgtatatcctttgtttctttcttacttttattatttgtgtggtttggtggttttctgcaatgataacatttgattcctttctctttctcatgagggtatctgctataccaatattttttatgctttttgagtgtttttataataatatatactgtatttttgcttccagatataggatttttaaataatatcttgtagggctgaccagtagtgatgaattccctcagtttttgcttgtctgagatatcaacaagcaaatttctccacatttctgaagagacagctttgtcagttataatattcttggttgaacactttttttttcttttcttctggcagtttgaatataatatataatatcattcttttctggagtgtacagtttctgttgagaaatctgctgttagtctgatagagattcctttagatacaacttgatgcttgatatggtttggatctgtgtccccatccaaatctaatgttgaaatgtaatccccgttattggaggtaggtcctggttggaggtgattggatcatggcggtagattcccctatcagtgccatactcgtgatagtgagtactcacgagatcttgtcatttaaaaatgtgtagcacctcctcgctatctttcttcccgctgtttcagctttgcaaggcaccagttccccttcagcttttgccatgattgtagccaagcagatgctgccagtcttcctgtacagcctgcagaaccgtgagccaagtaaacccattttctttataaattacccagtcacaggtatttctttatagcaatgcgagaatggactaatatagaaaattggtatcaagggaggcattgctataaagatacctgaaaatgtggaaggaactttgggactgggtaatgggcagtggttgaaatagtggaggcctcagaagaagacaggaagttgaaggaaagtttggaacttcctaaagacttgttagattgttataaccaaaatgataatagtgatatggacagtaaaggtgaggctgatgagacctcagttggaaatgagaaactcattgagaactggagcaaagttcacttttgttccttagcaaagcaattagctgcattgtattgttgccctagtgatctgtggaactttgaacttggtaatgatgatttaggttatctggtggaagaaatttctaagcaacaaagcattcaagttgtggcgtggctgcagctaatcacctacactgatacgcatgagcaaagaaatgacttgaaactggaagttatatttacaaagaaagcagggcatacaatttgggaaaatttacagcccaaccatgtggtagaaaagaaaaaccaatttttgggcaggtagggggattcaagtggactgcagaaatttgcagaagtaaagaggagccaagtaccagtagccaagacaatgggaaaaattcctcaaaggcatttcagagaccttcatggaagcccctcctatcacaagcccagaggcctaagaggaaagaatgcttccatgggtgaggcccatgcttatagccttgtgcaaccttgggacactgctccccacatcctagtcactccagctccagccaaggccaaaaggaccgaggtacagctcaggccactgctacagagggtgcaagccataagccttggtggcttccacatggtttcaagcctgtagatgcacacagtgcaagatttgaggctagagaacctctgcctagatttcagaggatgtgtgagaaagcctggatggccaggcagaagctggctggactgcaggttagagccctcatgtagaaactctcctagggcagtgcagagcggatatgtcaggttggagctcctacacagagccctcactggggcactgcctagtggagctgtgagaagaggaccaccatgcctcagaccccagaatgttagagccgactgtaacttgcaccatgtgcttggaaaagccacaaacactcaacagaagtccatgagatcaatcatgtagaataacccctgcaaagccactggggcagggttgcccaagaccttgggagcccacctcttgcaccagtgtgctctagatgtgaaacatgcagtcaagggatattattttgaagccttatcatttaatgactgccctacttggtttcagacttgcatggggcctgtaaccactttcttttggccaatttctccatactggaatgcgagtatttagtcagtgcctataacccctttgtgtcttggaagtaactaacttggtttttttttgttttttgtttttttttaaacggagtcttgctctgtcgccaggctggagtgcagtggtgcaattgcggctcactgcaacatccgcctcctggattcaagcaattctagtgcctcagcctcccaagtagctgggattacaggcatgcaccaccacacccagctaatttttgtattttttgtagagacggggtttcaccatgttggccaagatggttgtgatttcctcatctcatgatccacctgcctcagcctcccaaggtgctgggattacaggcatgagccaccacacccagccaactaactttgtttttattttacacactcataggcataagggactagccttgtctcagatgagactggactgtgggcttttgagttagtgctggaatgagttaaggcatggagattgttgggaaggcatgattgtattttgaaatgtgagaaggacataagatttgggagggcctggggtggacttactttgtttggatctgtgttcctacccaaagctcatcttgaaaactacttcctaatgttataggtggggtcttgtggaaggttattggatcatagggtagatttcctcgttgctcccattcttgtgatagtgagtgagttctcatgagatctggccttttaaaagtgtgtagcacctcccccatctctctttctcctgttttggctttgtaaagtttcagcttcccctttgtcttctgccatgattgaagctgagcagatgttgtcatgcttcttgtacagcctgtggaaccatcaaccaattaaacctcttttctttataaattacctagtctcaggtatttctttagagcgatatgataatggactaatataatgctattctcttactgtttttagaattctgtttttctctttgacttttgatattttaaatataatattcctcagagaagaccttttgagttcaatttacttgggaattttttaccatcttgtatgtggatgtctttatcttttccaagacttgaaaagtattctgttattattgtattaaataagaattttttatgcagctttccatttcttcccttcctggaactcacttaatgcaaatattggaacttatttgcataatggtatttcatatgtcacattggcctttttacaattttttttttccttttcctttttcttttttcagactggtttatttcaaaatacctttcttcaagttagtaaattctttcttctccttgatctacactgttgtcaaagctatcttttgtattttttattttgttcattaaattcttcgttttcaagatttggatttttataatgatatctattactttgtagaattatttatttagatcaccagtttttccctgatttctatttattgggtaattgtttgttcttttatctcactgagttttcttaagatcattattttggttttcatgcatttaaaacattttcttctgtggtctcctcctggagtattattatgttccttgggtgatgcaatgtttctttgctctttagggttttttgtgttcatacctggatgtctgtgcatctggtgtaactgttgtttcttccagtgttacgaaatagctttcataggatgtatttttcctttagatgtatttatagtgtcagttgaataggatactttggctttggttctgtgactgtacagtaaggtagtcttcatatgatttctttggctgtaatcaacatcagttatgtctgtgtgttcctcacggtttaggttgtggttgtttgtgtaggatgtggagtggatttgctggggacagggacatcaggcaggccaatccttgggtctctggggtcatgtgtaagtgcatggttgccactctactgaagggagtgggtttgctggtagcagcagtggtgagtcccatgtgtggtgagccattccatggggccatagagggcacatgtgaacactggaaggtccactgtgagccctgtgcaggctggccccacagcccctagtaccagaggtgcatagcagttccaccagtgaagtggactgtgtgccctgagcaaactgattctcaggcccctggcgagtacacatgagctttgattgtgtcaggggtgggtgctgggtgggccagtcttcaggcccctaggccacacttgcaagcatccgtagtgctattgacagactccaggcagtctgatcctgaggcccctgggtggcttgcatggatgctgtgatacttttgtaatatgaatttaaaagtatagaattttaaacttcatgtttaaccatttatttttcagtatcttatctcatttggatatgacccagactttttatgaatatccattgcctaatttaatataactttaatattttaaattacataaaaatttcatttataaagtttctctgatttgtatttacctaacgtatttatttttaacaacacctggattacttataaaaactgggatattagacaaggatagtcatcatttctaattatcttcttgttacagcctgtcaagatcaggtgtttatcacccaagtatgaatcttaaggttaaatgtattggtattttgctgataattaagaagatagaggtgtttacattaagccagcaatatttaattagtcgttttgttaatccatttcacgttataaaggaatacctaaggctggataacttataaataaaagaggtttattttgctcacagttctgcagtctgtagacgtgtgacactagcatctgcttctggtaaagcctcaggaggcttacaatcatggaagaagaggaagggaaatcatggcagaagagaaaggggaagcatgcctgtcacataggtaagatgtgggtgggagaggtctcagactcttttcaagaaacagatctcatggtaactcattacctcaggaatgacaccaagccgttcatgaaggttccatcctcatgacccaagcacctctcaccaggccccacccccaacactggaaaatcacatttcaccatgagaattggagggacagatatccaaattatatcagtcttacttatcaaggagttacataaaggatgatcgttttgcttttaagctgcttatataattttatgcccttaaaccattttagagacaaatataaaactgtctggccattaaacccaggctaaaaaatatatgctaacaattctaaagattatttttattttaccagcaaatttaaagccaccttatttattaaagatttactcaaagcatgtgaactaaaaggcatttggataaattagtaaatattttaacagtcttaagtattaaattatatgagttctcatttattaaaaccaatcttaatagaatttattaaggtatttctgaccaattatgctagattttaccctgtagacacaacatactacgtgtgtaaacacacatgaacacatatgtacacacaaagatatagctttcattttagaattttagacatgagacattaatatgttctgatctgtaatcttatcatggctgtaaaccaaattttgggtaaagcagttttcatagaaatttttttctaaaaaatgcatattttactccatttccccttttttttcattttcagttgagttaggggttaattccttgtcgccttgtatcattggaatgccattagaaaaacaatctatgagtgagattttccttgtttttatttaaatttgtaactacaaagactgttgaagcattcagtttttattttaatacaagcaaaagaaaaatcagcagattcagagtaggcagaagaaaaacaatacatagagaacttgaaagcctgtacatgtaaatcttatagatgcagtttccttatagagttcaaataatggccattgagctctgaatatatatatatatatatatatagagagagagagagagagagagagagagagagagagagtgtgtgagtgagtcagcatcttacttgtcacccaggctggagtgaagtagcataatcatggctcactgcagccttgacctcctgggctcagggaatcctccttcagcatgctgagtaactggggctacaggcccataccaccatgcctggctaatttttgaattttttgtagagacggggttttgtcatattgcccaggctggtcttgaactcctgggctcaagcaatccacccacctcagcttcccatagtgctggggttaaatgtgtgagccactgctcctggccaagctctgattttttttgtgtaatttcctcatcagtttaaaaatgtgtacaagaatgtgctataatatagccctcctagaatccctgaaagaaggttgttctggaatgccattagaacttgaagatcccattccatttcttattaatctttcagagcaaagaaaatcattttccctgctgtatgaaatttaaagtgtatacttaccagaaattcaaaatgtctctaatagaaaggacttgtgttaaaaatgcaaaaagtcttttgtcttcataagagaaatgcgggttccttatgaaggtggatttatctaagtcagatctcaaataaagtcagcaggaaacatctgccaaaaatagggcatcttggcctgagaggagactcaccagacactaaaggtgaggtgtggaaggggagagcagagggctcaggtgactgctgcacactgttcttaagaattactgcttttttccaaaggtaatcttgctccacttctgactctagatatgtcaacctaaataaaagacgaagagagagtctccgaagacactgagtttattcaggagtgtgcaagggatttgcacttccaggatatgcagcctataggattcatagacctatccaaagagattgaggaacgggcaaacttttaaagacaaaaggaaaaagaacatgtaatttgttttgaaacaaagagaatattggtgacaagggcttatctcaggagtccataccagttcattatggagacagtgttaatcaagtgttcttatgcatccagctagctatcctgtaactcatgtagcaagctcaagtttgaaaagtcattggcaaaagtttttgttacagacatttgtaattgttctgatcataagcatgagtgtgtgagggtcctcgcttcttaacctcccatctttatctatgttttgttggggtttgatgcaagcaatccattttgagtttgataacttttacaatatcaagcaaattctaagcaaaacaaaactgatgtagttgtattaatattatgtaaaatagaatttagggcggggcgcggtggctcacgccttgtaatccaagcactttgggaggccgaggcaggtggatcacgaggtcaggagatcgagaccatcctggcttacacggtgaaaccccgtctctactaaaaatacaaaaaattagccaggcaaggtggcgggcgcctgtagtcccagctacgtgggaggctgaggcaggagaatggtatgaacccgggaggcggagcttgcagtgagccgagatcgcgccactccactccagcctaggtgacagagcgagactgtgtctcgaaaaaaaaatagaatttaaaacagaaagcaaagatagaaaatcttcactgctaacaggttgtctttatcacaacggtataataaattataatttataattatctaacagcatagcgtcattgtatttttaaaaatggcaaaattttaacataactttctcagtaaatgataggtcaagcatataaaaatcatttaaaaattgtacaatataatgaatcaccttgatttataaggtatatggaaccctgatcaaaaagggaacaaaaatgtatgtacacatacaacatttatgaagattaactatatatgacaccgaaaagcaagtttctgaatgttttaaagaatcagtttcagacagaccgcattctgttactgtaatgcagaaagtttcaaactgaaattaaaaaattgaacctgaaatgccaggaatgaacaaattttaaaatgtaagcactatctaatatgacaaagaggtaattgaggtagaaattagaaaatacttggagttgaataatactggaaatgttacttaccaaaacttctgaagtatggaaaaagcactacttagagaaaaatctatagtcttaactattcatatttaaaacaaatacaaaagctgaacattaatgagctatgtatctcatgtaagcaatttaagaactacaaaaaaaccaaaataaagtacaaagaagaaataatgaagtgagtaacaaaaatttttaaaaaattaaatagtgggggtaaacaaataccacaatcagtttttttaaaaatactaataaatgagagagactggctagattattaaatagatgaaagagaaggtatacataatcaatgataggtttgaaaaggtagacgtagtaaaatagtatgcattttcttgattcttgtaaaataaaaatatagatatttagtaaaataatgtgtttacaaatttactacatttcaacggggccaagcagtctattagtcacagtaggtacagggcctagggctcaggatatttttagggacgcatgaaaggatttaattttactttttaaattgtaaaaaaaatgaatatagtcataatgaatatctaataatgaatccaggcaggattaaatttgtttctatacccacatagtcataaaatattatttttctatatctattgctgaatttatgtatttattttttaatatatgtttagggaagaaggagctaacaaaggcaaaagtgctttggacccactaaagtcatgatacagccctgaattcaatagcatacaataataaattttaaaatacttcaagttatattaagtacaatatatataatatgattttataataattatgcctcctaaaatactttgcaactacatgtttaaattatgttttctaaagatagaaaaatattaaacagtattttattaaagtcctcttaagaatcagtttttaatttttattgcaaaatagtcagcaataaacatatatgttatatagttgtaaatataagacttgatattaacattattggaatgacataattgttttggaaaaactaagcaatatcatcttcgattataaaatttaacaatgagatataaaagcaatgtgagagtggtatgcagaagctgcctggagccaatttgtaggagcctattgtgtgcaactcttcccaactctgcgttcagtgtcatcaccttggtattttgaagtaggccatgatgagagtgtttgcaacacagaaatctgcaaaccctgcaaatgaggacccctcccccactgtttggacagctgactgttaaacatttactaccacactactgtatggagtatacgatacataaaagtagtgtctataatgctcctatataaaataattagggggtgataaggagattatctttgaataacttctactcgtctttacaggatatatttcattttctttaagtttctaagttggatctgcaatatctttagaatttgtaaccagaactactttttaattccccttagaagatttcaaatgttttcaggcaatattagtttactatcataatactaaattaaaaccaaagcaggtatggcctttaaaattcaaggggatactttgtggaagggaggttgcgaaacaagcagtgtagactggcagaaacaaaaattatataccttccctaaaagccaaataagatattgggttttataacagtgtcttatttgatactttacagtgttagtggatgctgcctttaataaggaaaatataaatatatttggaacagtacattttgtttttcaatacaaggtcttttggtagctgcaaacactgatgattagcattttgttcgaaattgtatggatgaaactgaaaatggaagagttgtcactgtaaattttttgagctgatagaaatttctgatggaattttttactttggaaattttcaaaaatactaagaagcaaataataatttgtatttccacactcataatttaatgctattaatttcttggcatagttgcttgtagttttataccttttttgttaagaaaaatcactattgttgctgaaaaatattacacatgtgtattgaaaatattcaaacaaaaaagtttagaaaagaaagaaaaaatagaccatgaatattctatctggaaagttttatccataacattctagaaacacctttgcaggtgttttatctgtacataaatacagaaaaatgagggttcaaagaaaggaaacttcacacattcagtccctgagttcctagaactccattcatgcaatttaatcaagaacctattcccagaactccattcatgcaatttaatcaagaacctagaattggatgccaaggcgcataggaatgaccctatatgcttatatttccaacctcaatgaacaaactcttctttctctagatgacatttccaatcctccaaatctaagcccctcaagcagccccaacttgttcgttcctctgtcagtataaagattatccttgaatgcatacccttacttaaacaatcctcacactttccccctcatctcctgaattttctccagcctgccttgcagagtaaatattttactaataataatttgtactacatggtatatctccatgccccctgaaactggtattgacctgaatcaaaatactccaaaatattaaacccttctcagctagtttggttacttatcattcatcatttttataacacacacactcatatacatacacttactttgttaaaaataaagagaacttaaaaacaatggcatacataatctgtaagttgtcagataaagcatttgttttcttttcctatgtcagttgttgtttctggaaggtggaagagggaattaggaataattatactttattatatatgttgctcagtggccaaatcaacataggttcattttaaacatcagctgttctggtaatcatcatacttagaggtaatagtaatttggctcaaatactttatttttgggcatattgcttaagcatctgtccatgaattagcttttgtaatgtttcaatatgttctggttcatgttgggtatatttgattctgttacagtaagttaataccatagattttcaaagtagtccttggataatgtttaatatgtttccttagacaggcagcaatttaaatcattttttgtgactcttaatctacttttcatcttattcaaatttgatactagcaatgaacttgcaaatcgctttctcagatttcacagactacattaggttagatttgaaagaaaaataggtgaattgtcacagtaaagaaaatatttattacttattcatatagatataaaatttatttttcaaactcaagttattgtattattgttgatttacatatgaattccagagtagcatctgcatatgagccatttcctaatgcagaaatcatcaatagagaggttatactgttgattagcctcttgaatatcctcagcacatatgtatttctatctcctaatatttaacatggtttttgcctccatataacctccatattttatgatttgatgatagaaatataattaggcacataaatgaggtaatttttacaaaatattttttagtgagataaaatttgcaaaacttgaaaatcaaccattttaaacagcccggtgtcactttgtgtattcacaaagatgggcacccaccgcttccatctagtttcaaaacattacagcaccacaaaataaaaccctttacccactaagcagttgctccccattctcctctcccctgccagatccctggcagtcaccaacctgaagtgggtctttgtatttacctattctgagtatttcacataaatagaattacacagtatgtgaccttttgtgtttggcttctttcacttatctttacgtttttgaagtttattcagattatgtcatgtattagtatttctttttttttgagacatagtctcacgttgttgctaagactggagtgcagtggtaagacctcagctcattgcaacctctgcctcctgggttctagctattcttttgcctcagcctcccgagtaactgagattacaggcacacacaaccgcgcctggctaattttttgtatttttaatagagacagggtttcaccaagttggccaggctggtcttgaactgctgacctcaagtgatgcgctcccctgagcctcccaaagtgttgggattcaggcatgagctactgcaccccacctcattgtattttcataccacaatttatttgtcacttcatcccttgattgatatttgggctgtttctaccttttggcaattgtgaatagtgctgctaagaacacgagtgtatttgtttgataacctgtttttacttcttttgggtatactcctaggagtggaattgccagttaatatggttgttctatttttaactttttgaggaaccaccaaaatgttttccacagtttgaaatgaaccatgttggctgaggcgggcagatcacaaggtcaggaattcgagaccaggctggccaacatagtgaaaccccagctctactaaaaaaatacaaaaattagctgggcatggtggtgtgcacctgtaattccagctacttgggaggcggaggcaggagaattgcttgaacccgggaggcggaggttacagtgagccaagatcgcaccactgcactccagcctgggcaacagagcaagactctgtctcaaaaaaaaaaaaaagaaagaaaaaaaaagaaatgaaccattttatagtatttccaccagcgatgtatgcgagtttcagtttcttcacatttttgccatcacttatttttgatttttaaaattatacagctattctcatgggtgtgagggcgtatctcattttggttatccctaataactaataatgttgaacatcttttcatatgcttcttggccatttgtatatcttttttggagaaacgtctattcaagttctttgcccatttcttagttggactgatgatttgttgttgttgcattgtaagggttttttatataacctagatgctagatccctatcagataaatgatttgcaagtattttctcccgttctatagattgtcttttcattttctttaaaatattatttaatgcacaaaagttttaaattttgatgaagttcaatttatactttttttcttttgttgcttgcgcttttggtgtcatgtctaagaattcattgccaaatccaacatcataaagatttatctctttgttttcttctaacagatttgctttagctcttataattaggtatttgatcaactttgaggtaatttttctatgtggtgtgagtccaacttcattctatttttgcaatagtatttggttggtgcaaaagtaattgcggttttggtattacttttatggcaaaaactgcaattatttttgcaccaatctaatatatccagttgtcccagtccaatttttttgaagagtctattctttcctaattgaatagtcttggccttcatgtctaaaatcaattggctatagatgtatgagtttatctctcatttttattccattactctcatttttattccatttctatttaataccattttatttttatatcattttcattccattactctatatgtttttctttacaaatatttcaaagctaaataacttaggaattgggcattatccacaatgtttttaaatgattaatctggaattttaaattaagatataattatgtagataatatgttgtaggcactgtgctatgtagagcaaacatagacttgaatatgatactgtctttactctcaaggaagagcttaatgtttagtgcgggtccaactttagtaaaccaacaatttaagttcagtctgataaatgctcagattgagtacgggatgttataggagtgtaggggatgtaacaggtgtactcaccaatgtctattctactccaagtaattagtctgaagtaatcatgaatcctattctccttgccagacatgatgttttcaaggataggtatgcctaagtcaatttaagccatgagagtccccaggagaggttactgaggagttctggatatggttttattgctcttaagagaaagtataggaagcttctctcttcccagtgaaaataaatgaggaaatgttttccaaagtggtaattgttgcatgaagccatattggagactgcagagcagagagtcaagactgaactgtcttctgatggcatcactgaatcattagttgaaccaactcggaattcagaaccatctgtagtcttccttttctgtgagctcatcatttccttaactctttattatagtttaaacatggaattctgtttcctgaagataaaaagtcctgtaaggaacacagtactagaagtacatctaaatcggattgaggaatacttaaatggcttctcggagaagatggtatttgagttgaatgttgacttttgaattaaatgttaaagaacaagtagtagttagctaataagaagcagcatgattttaaaatattttctctcaacttataggttcccttttcattttgtttcctgtactgtgcaaaagacttttagtctgatacaatcccacatgtttatttttgcttgcattgcctgtatatggtgtcatatccaaaatatctttaccaagaccagtgtcgaggagctgtttccctttgtttaattatcagaattttatggtttcaattctcatacaacttagtagaaaaaaaatttaaaaatggacaaaagacttgaataggcattttcccaaagaaaacatacagaaggacaatagatatatgaaaaggtgctcaacattaccaagcatcagggaaatgaaaattaaaaccacaatgagatattatcttacatctgataggatgcctgttatcaaaaaataaaaagtacaagtgttggtgatgatgtgaagaaaagggaaactttaagcactgttagtgagagtgtcaacaggtacagctattatagaaaacaatacggacattcctcaaaaaattagaaataaaaataccatatgatccaacaaatctacttctgggtatatattcaaagaaattgaaataagtctctccaagagacatctgcactcccattacagcattattcataatagtcaaaatatgcaaacaacccatttgtccattgatagatggataaagaaataagatttatgtatatttaaatatttaaatatatatttacaaatttagtatttatatatgtatattatatccatattgaatagatatttaatagatatcatatatctatatttaagatatatatttaatagatatatatttaatagatatgtattgtacatctatatttaatagatatataatatatgtattatacacacacacacacacacacacacacacacacacacacacacacacattggaattttttcagccttaaaaaaggagatcctgtcttttgcaacaacctggatgaatgtagagtacattacactaagtgaaataagccagacaccaaagaaaaatattgcaggatcttacttatatgtggaaagtaaaaaggcctaatcatagaagaaagtaggactatgcttaccaggggtggggaggggggtgtgtacgggaaatggggagatgttggtcaaatggtacaacgtttcatatactagaatgactatattctagagatctaatgtgcagcatggggagtatagttactaatattgtatactcgaaacttactaaggtgaggctagatcctaaatattcccaccacatcaaaaattagtaactatatgaagggatagatttattaattagcttgactgtagttcactatgtatatgtatatcaaaatatattgtataccttaaacatacataaattttataaaaataaattgacaataattaaataaatagagagcacaaatggtagttaaaaagagccttaagatattacacatgctaacaaagattttacagtataaataggataatagaatatagaaatagaaagacaatgtatgctatcatatgtaatatgttttctaggtttcacatcaatcctcttaggaagataattgagtataagggaatagatgggagagacactttgaaatgctgtaactcaacagtaacataattatataagcacataattgttgaggccagatgtgttgataccacaccttgaggagttttcaaagcatcaaagttataataaagagatgatgatatggtctagttaattactgcctatagtagcatattaaatctgtaaactacagtgctgctaccaaatctaagatactgataccttctgatattatcgagatcacattttgaaaggaagagaatgcctagagaccattttcaatggttttctaggactgagctgtgaatagcggtaatctgaaaaacaatggcaagtcgagtctatattccaacccatatttaaggggaaataagatttggcactttggaaattcatctatcaagaatatatatcaatatatagttgtactcatcactgtgttcatactctgctgaccaaaatttaaatgctagctaaaaaggattctgggaagtatgggttttagttatgcatccttgtacctgtctaaaattcaggatgttttattactaaaaagaagaagggaagaattaattctggaaaacaattaactgtggaattatatagatcccagcagtaagttatttagtctaggaactaggtggaagcaaggagaccatataggcaagtaatccagtgatctagatgtgaagtaataaataatgctaccagacttatgaggttggcactgaaaaggattgggtggatccaataaatgttgcaaggaaagaagcactataacttcatgactggaaaacagaaagaaataaataaaaatcaatgcttgattatttttatatgatcttcagggaaataatcaagttggttataaataagaactcctgttatattaacagtaataatagggataagaaagaggatggttctttttaaaaatacctggtttatagttttaaagaatctattttgtaaaggacaagaactgtctttctcttacaaatttcactcaaatatgtagatgattttgattatcttgacaagcaacctaattttacatgttgtgatatacttgatattctgtaagaggtctaaagaactgataatgtaaagggaaaatgcattcggtgaatgaatatgctgcattatttatttgttattcatcatactgggaaattgtagcaggtagagactggtgagattatcacacacaaacacacaattttttggtaagccacaatacatgaataatgttatactaactttaaaaaatgagtcaatattataaatacaaattctagggcctcacattaactttttattttattttattttattttattttattttattttattttttgagacagagtctcactctgtcgcccaggctggtgtgcagtggtgcgatcctagctcactacaacctccgcctcccggatttaaatgattctcatgcctcagtctcccaagtagctgggattacaggcatgcactgccacacccgggtaatttttgtattttgttttgttttgttttaagtagtagagacagggttttaccatgttggccaggctggcctcgaactcctcacctcaagtgatcctcccgcctcggccacccaaagtgctgggattacaggcgtgagccactacacctggcctaaagttaatattttaagcgacaatcttcttgcccattattcactgcaaaaatgcatacatctctaatgggataaccacttctatcttgaaataaagatgtgtaagtcttggttctgtctatgctaatgtaagtatttttatcactgtaagtttgtacatttgattgtttgggacttgtcttggacagtttcttactgtgtgtttgaatttggtctatagatttacactataaggaaacaagtttattattttcttctataagaatttatagttatttcaaagttatgagttgaaatgttttgatagaagactacataaccatgggttctgattcaaaaataagtccaatcagtaatactcatagttacttgctatgagttgttaattaacttgttgttaattgtttgcaagatagataaaattagtaatggtttatcattattgactcccaaaccatcctgtttggatatgtgacatgtgcattttaagagttacagatactgaaagcaagatctaatatagaatttttaaaacacttttagctatctaccaagtcctttggtcatagattatttctaagaataataaaacattgatatcctaaagtatttgacaccagtgatttcttggaaagtgagcaatttgatatttccattgatagacatattagcatggctatatttgctagtagttgtaggtaaattcctttattataaaataaatttacctttattatcattattatgttttataccctcaagtggattgccagtactatcacagggaaaagagggttcttgggtctgagaattttgaaattttgtttcctcttaagaataaaaaataagtgttatatgtaacatcttgataaggaaatattaatgataccgagctctgaaaattaaaattagcgtctgtggaaaaagtaagccaaactagttttattcactaaaacacctaaaatcaactttttgatatatacaatctaccgtggttattatgcacttttatatctttgccaaattatccttacaattttccgactcactgtaatgaaacatattttccacttcatgctataccgtggcatttcattagtgtctataatggtacttgaattcaatcagccatattaagaactgacctatttacaggatggttcaaacaatggtgatacatacatttagatattgatagttttaaattctggtaaaaggtaacgttttatgactgatgaaattaatactggaacaatgagtttaattgaccaccagacagtatgcaaataaaatgtcaaaaattcatataatttaatagtccattaagcctaatggagttatatcccatataagccaaaggattcaagtagaattctattttggataatcatctgttactatttgaatataatttagaaaaatgcttagttctttactgtttgaatgtaacttagaaaaatgcttaatctaaaatatttaaaatatttatatgattttttactggataaaaataaacatgctcaagagtttaaaaatagatgcattttatcacttctaaagaggttataagtctacaatgcaaatattgtcagtgtctagatgtgccggcaagatggcctctgatctgccaccacctgatagtgtagttcccagaaaaccttgagttatcaaaagctgtgttataaaaattgcatatccatgagaacaaaagggccttagggcctagagagtttgaaaaaaaattacaaaaaaaaattatagtttcctgtagaaattttaataaatgctctcttagattctctaaaagatgttataaatctaaatgtgaaaacaaaatatttattaacatattttcatgaccttggagtaggcaaagttttctaaatgagacttttcaaatcattaatcataaaagaataaaactaataacctggaccatattaaagtaagaacttatcttcgtcaaagtacattattaaattagtgaaaaaacaagcaatggagtgagagaaggtattttcaatacataaatctcatattcagaatacataaagaacgttttacaaatcaatgaaaaaagatagagacaacagagtgggaaaagtggtaaaaaaaaaaaaaaaattgaacagaacttcatcataggtatccagacacccaataggcatatgtaaaggatctcaacttccttagttatttgagaaatgcaaaataaaactacaatgagataccattacacatctatcaaatggctaaaatgaaaaagacaatacaagatttgaaaaagatgtgtagcagttgaacctcttattcactactgtagagtgtaaattggtacaactctttttgataattatttggcagtatatattaaagctgagtatatggataccctgtaactgagaaatttgactcttagctacatacccaatagtaatgcaaacataagtttgccaaaaccaccatacaagtatgctcataatagcattaccaataatagccacaacctggtattactcaaaatgcccgtcagtagtatcatttttaaaaacaaaagatagtaatggtatgttctcacaatcagacactgtacaggaaaaaaatcagtgagtgaaccactacatgtaagtataacaaggtagatggatttcaaagaaataatgtctacatatacacaaagctagaaacataagaataaatacttaggattgggtttatttacagttcaataaaagacaaaactaatcagtatgttatgtcaggtgagcgcttccccatgtgaggagtggtcttcactgggaagaatatgaggagggcttttggagtactgctaatataggatttcttattctagatcatagttacacagatatgttcaattttcgaaaattagttgagatacttacgatttctcatcatttctgtattttctacttcagtaaaatttaaattgtgttccgtgcaggtaggcaaccatcaaaagggacccagttcacaacaaggagataaaccttggtagcctctttatcccttggttccgacactcttctccctcacttagagacgtagaggcagctggcaatagcaatagggggatcccaccacatccctatctcacagagagacatcctgcagccagccctggaaaatcccttccattcttcccaggtaacaccagtatgtaccagtgggagctgcagaggcaccaaatgtactgtaagaccaacataagatcgcaaaggctatgaaatttaaaccatcattggaaccacagcccaccatagttatgtcaagacctacgtgttatgtgctaacaaagagaatgcctactaaataaaagatttaaatagaactcagagtctcctatgtgagaaacatgtttcctcaaaaattgcttgtagaaatataaagtgatttcatcttttataggaaatagtttggctatacctcaaggtattaaacataggttaccatatggcccagaaatttaactagatacttactcaagagaaatgaaaacataagcctcaaaaacttacatatgaatgtacatagcaatattattcacagtaaacaaaaagtggaaacagctcaaatgtctagcaactgattaatgaataatcaaatcatagcatatccatacagtggaatattatttgctaataaaaaggaatgacgtacagtcatatgccacataacaaaatttcatcatcagactgcatacacagcaatggtcccaagagatcaggagttataggaactgaaacaggacgataaaaaaagaagaacccccaagtaaattcatagtaaacaggtcagaagaagctgttgcagacctcaagaagctccttaaaaagtttgaaaacatggacctcaatacctagtggtcttaactaacagagaagaatgtccatggtgtattatctgcttaaaagcaaatctatgatgaaaattaactgaccatatcaccgtggacacatttctgaaaagggtgacaattcctcaagaatagccccacacaagtcctttaggaagcattccagaaaaaggcatgcttgtctaggagatgacagcttcatgaatgttattgctcctgaagacattccggtgtaataagatgtggaggtggaagacagtgatactacttaacctgaagggtaatatatgcatctgtcttagtttttttaaaaaaactttaaaaagtaaaaccaaagttaaaattttaaaaatgtgaaagtaaatcaaagcttatagagtaaagacctaaagaaaatatttttgtatagcagtatgtatgttttaacctgcgttattatggaagtcagaaaattaaaaaaattacaaagcttataaagtaaaataattaaaaagtaagctaaagtcaatttattactattattattattattattattattattattattattttgagatggaatctcgctctgtcacccaggctggagtgcagtggtgcaatcttggctcactgcaacctccgcctcccgagttcaagcaattcccctgcctcagcctcccaagtagctgggattccaggcatgcaccaccacacccagctagtttttgttttgttagtagagacagagtttcaccgtgttggtcaggatggtctcgaactcctgacctcgtgatctgcctgccttggcctcccaaagggctaagattacaggcatgagccaccgcgcccggctattaacttcttattaaagacagaaaaatatgtttataaatgtagtgtgacctacttatactatacagtttttataaagtcttttataaagtctactatacagtttttataaagtagtatacattaatgtcctaggcttccacattcactcactactcactcactgacaccaagaacaacttccagtcctgcaaacttcattcatgataaatgccctatataggtatgacattttaaatcttttatcctgtatttttactgtaccttttctatatttagatatgtttagatatatagacacttaccgtagtattacaattgcctacagtcttcagtacagtaacatgctgtacagtttgtaacctaggagcaataagctgtgctatatagcctaatatactccatgatgttctcacaatgacaaaattgtctaatgatgtatttctcaaaatgtatccccgtcattgagtatcacatggctatattaatatgtatagtaagcttgaaccttgcatgcattattctaagtgaaagaagccagacacaaaaggccacttattgtacagaatgtccaaataggcaaatccagaggcaaaaagtagttagtggtttcagacactttgagagtagggaatgagtagtgactgctaatgggtatggagtatcttttaaggaaaaccaaaacattatggaattagatattggtggtaattgcacaactgtatagaaaaactaaaaaccgctctttggacatgaacatggcgaattttatggtatgtataaaacttattttaaataaagaatcaaatgaagattataaaactgaaagattcagtaagagaaataaaaataatttgctggattagccagtagtaaagtagagatgacagagaattgaatcactgaaattgcggataaaacaatagtattcactctgcagataaaatagagtgaaagattatgaacatagcatcagttcttacatgataggaactaaagagccaacattaataccatctgagtcacaggagtggagaagagggtggggctgaaagaatatttgaggaaataaaggctgaaaactatcccaatttggcaaaatacagaaacctacaggtccaagaagacaattgaacaccaaagaggttaaatgctaagaaatccccaccaaaatacatcataattaagtttttgaaaaatataatcagagaagaaaatcttaaaagcaaccagaaacaacacactacatattgacaccaatttgaatgtcagcaaatttctctttttaaactatggagtctgtaaagaagtggcataatttccaagtgctataagaaaagaacttcaaactgtgaattctgtgtttagagaaactatccttcatgaatgaaagggaaacaaaaacactgtcagatgaatgcaaactaaaatcatttatctgctacagaccttcctttaaaattgtgtaacagaagttcttcaaatggaaaggaaatgacaaaggaaagtaatttaaagtataacctacataccattggctatcctcttcctcatgaaatttgtaaatcttttatgattgaaacaaaaagtataatcctatctgatactcagtgcaatgatatttaaaagttgagaaggtaaaggtaaaaattggacatgtggtttcacacttcattctaagtggaaaatgctgatactggtgaactactttaattcatatatgtatgtagcagtacacagagcaaccactatggaaactacacagggagatacattcaacactataaataaatcaaaatagattcctaaagtatgttaaagtagtccaaaggaaggcaaaagaagagagagggataaaatgatgaaaatgaggggtttttttttcaatttttttgattatactttaagttctgagatacatgtgcagaacgtgctgtttgttacataggtatatacatgtgccatggtggtttgttgcgcccatcaaccgtcatctaggttttaagctccacatgcattaggtatttgtcctaatgctctccctcccctggccccctacaccccgacctgcccagtgtgtgatgtgttcttattcaactcgaacatcccgtgtttggttttcttttcctgtgtttgctgttaatgatggtttccagcttcatccatgtccctgccaaggacatgaactcattcatttggctgcatagtattccatggcatatatgtgccacattttctttatccagtctatcactgatgggcatttgggttggttccaagtctttgctattgtgaatagcgctgcaataaacatatatgtgcatgtgtctttatagtagaatgatttataatcctttgggaatatacccagtaatgggattgctgggtcaaatggtatttctggttctagatcattgaggaattgccatactgtcttccacaatggttgaacctaatttacactcccaccaacagtgtaaaagcattccagtttctccacatccttgccagcctctgttgtttcctgactttttagtgatcgccattcaaactggcatgagatggtacctcattgtagttttgatttgcatttctctaatgatgagtgatgatgaagtttttttcatacgtttgttggccgcataaatgtgttcttttgagaagtgtctgttcatatcctttacccactttttgatggggttgtatttttcttgtaaatttgtttaagttccttgtagattctggatattagctttttgtcagatggatagattgcaaaaattttcttccattctgtaggttgcctgttcgctgatgataatttcttttgctgtgcagaagctctttagtttaattagatcccatttgtcaattttggcttttgttgcaattgcctttggtgttttaatcatgaagtctttgcccatgcctatgtcctgaatggtattgcctaggttttcttctagagtttttatggttttaagttttacatttaagcctttaatccatcttgagttaatttttgtataaggtgtaaggaaggggtccagtttcagttttctgcatatggctagccagttttcccagcaccatttattaaatagggaatcctttccccattgcttttaaaggtaggaacaaaatgcagttgcttacaaccaccagtgttattttgccctgatctggaagatgagccaatgcaagcagataagaagcatatttattagtaatacaatcatatctattgaagaaacagcaaaacaataatataattcattattgcagatagttgtaacattatattaaagcttttaaaattctttgcctatggaataattatagcttcctttctaagtctgatttcaacttgatcatataatcaattgatgcttctctatactcttccaggctggaatataataggagctaccatttacttgtttgataggctctacctctgtcatgctttcacagaagaggcttttactataaagaagtcacacattgccctagttaaactgtccagttaagttcctgaaatattgttacagtgccaaaaccaatcatctttgtagatatggttcttagtatttgagaaaacaaatcaggttgtttaagagggagaccttcctagatagaaaaactagactccacagatagaggattgtgtgcacctatgtgatattactactctactaaattctatattatttcatttaactatttacataattttctcataaaacattagctagcaacatgcttatttaaaccttttatgttaaaatttttgtaattttgcactgtaagatgagctaatgcaaatagataagaaatgtatttattagatattcagtcgtatctattgaagggacagaaaaacaaggtaattcattattgtagataattataaaattattttatataaaatattttaatattctttgcccatgtaataatcatagacttatttctcaatctgatttcatcgtgattattataatcatttcatgagctctctatagaatatttgaaaagtatgtgattgattacttaaacaagtaaactataatgtaagctggcactattataaaataaacacgcagagcaatagagttattactatatatgtgaacctagagattttagtattataatgttactaatattttaaattacatcgtacagcataataacaaaagttttcagactcaatggtgttagcaagggtagcacatacaaggccaaaatataaaatcaagggtatttccatatattcacaatgaacaataagaaattgaaatcaaaagaatgcaattcctaaaacttcctaacataggaaacacttacatatgaatttaacaaagtgttctgaaaactacacaacactgatgaaagaaatcaaagaataccgaactaatgaagaaatagacattttttgaattagaagaattaatgttgtcagtcttcctcaaattgatcaatagattcaacatactcctaataaaaattctagtgcttttttttttctttttttttgagatggagttttgctcttgtggcccaggctagagtgcaatggagcaatcttggctcactgcaacctctgcctcccgggttcaagcaattctcctgcctaagcctccctagtagttggggttacaggtgcccaccaacatgccaggctaattatttgtatttttagtagagacagggtttcaccatattggccaggcttgtctcgaactcctgacctcaggtgatccgcccgccttggcctcccaaagtgctgggattacaggcctgaaccactgcgcctggccaattctaatgtatttttatgaattagtaggctgataaaatttatatggaaatgcaaaggaactaaaatagcctgagcaattttgagaaagaatgaagttggaggattggtaacacttgatttcgaggcttattctaaagcagtggctctcaacagaggactcttttgcaccctcaggaaacatttggcaatgtctggggacattttgcttctcataacttcgaggtttctactggcagctagtggatagaggctagggaatctgataaacatttgcaatgcaaagtatggcactcagacaaattatccagcccaaaatgttaatattggcaaggttgaaaaaacctgatctaagctccagtaatcaagaaagtgcaacattcattaaagagtagatccatatatcaataaaacataaatatacccacatatatatgatcaactgattttcaaccaagatgcaaaggtgtttcaatggagaatagataaacccttcaacaaatagtgctggaacaattgggtataaatatgcaaaaaataataataactttgacctcatacttcacattcatatacaaaaattaactcaaaattgattataaacctaaacgtaaagctgaaaatcataaaatacctaaacaaaacacaggagaaaatctttgtgacctggaccaggaaaagactttctaggtatgatatcaaaaccatgatccatgtaagaacatattgataaattagaattacaaagtaataatgaataaataagccacagacagggataaaaatttgtagagcacatatctgacaaagaacttgaatctaaaatatataaaggattctcaaaactcaagaaaacaaaaatgatgcagtttttaaaaagggcaaaagatttgagtagacactttaacaaagaagatatatggatgaccaataagaatatgatgatactcaatatcattagtcttagacaaatacaaattaagaatgcagtatgacaccactgctgcacctacttctactactactactacacacacacatgcacacccccaaacaaacaaacaaaaaccccttaaaataccagatgagaacacagaacttctgcaattcctgtgccttgctgttgggaatacaaaatggtacagtcactttgaaaaaacaggcagtttttaagtatagttaagcatatacataccaatgacataatctcatttctccatctttaccccaaagaagcaagaacttaggtgcacacaaaagctgtatgtgaacgtttgtagtggctttattcataaacaccaaaacctgggaacaatctaatattcatcacctggtgaatatataaacaaagtgtagtatgtttacacaatggaatgctacctggtactaaaaggaactaaactactgatacaacagcgtggatgaatctcaaatgcattatgccaaacaaaagaagcaaaatttcaaaaactaagatcttatttgattccccagcagcctgaaccaatcacattgagcttgttttgtgttacagaaaaacatttttttactctttaatctgtgtgttcttggaggcctctgttacaatggccaaccttaccttaactacgcacagtgtgtaccaaacactgctgcactctcacatttagttctcacgacaatattgtatgtaggcattttaaactcatttttacagaagaggagaatgagtctcaaagagatagagtaacttgctcaaggtcgcatagcccaaacattttggattcagatctattccaaagtctgtatacttttgccatatatagggttgtaagtcagacagacctgggttcaaatcctcatttagccatttactcctcttaagatttgctagacgttaaagataaatttggatgtggctatttcacagtgctgtgagaatttaagtaataaaaggatatacaatttggttcaaagtaaacactaaataaatgctgactgttattatgcctcaatgcctctcctcatctgtatacatacttgggattttgcagtaattataaaactacatataaagtgcttagaagcaatatatctgggatgttgttagctttaattattattcttgtatttgttatacatgcttaattggggaaacttctttgattccagtaagttcattctcaaaatgtgctttgcattctatctaaaatttctcgtgaaatagttacattcctgaaccagtcacttgcaagatagaaaggcgtatatcacttctgacattcattcccagttgagtttggagcatatacagtcagagatgttatcaagataccaagattttgcttcattactcaacactaatggacaagctgaagtagtttatttttcgaagagactctgaagcacacttaaggttttcattgtttactatgctattctgtgttcaacaatagaagggtatatatcaagcttgtccagttcattcacttacatgatattttataatataaatgggaaactgtatgggatacttctgtttaagcccataactcattttttttaaaaaaagtattctcttcatctaaatacattgtttcttgaaaaaaaattttccaaaaagtaatgcagtgaaaattgttctttcttccttgttcctcctctacactgttcctattccattctcaatgggagatatatatatatttgtatatatataatatagatttatatatctatataatatatttatatatctatataatagagatttatatatatataaatataaaaaaatatatatccctctggatatttctccttttttgaatgcatataaaagcactacagaattttccaagaattttgtcatttaaccaaactgaactcttggcacaccatttagatgaaaagatgtgtttgttccatgtggatccctagtatgtctgctaacaggattgacaataacagacattagaaacatactctgaatgtttactagttttacttaatctgtttgtctctggcagtgattcagaatggagttagtctggagctgttattgaacttcattgttactgttcttgaagccccactcatttcctgccaccccatccctattgtgtttgaagtagaaagctaaagtgttgtaagatggtgaagaggaacacagacatgttttagtccttggcatctcaaggcaaaattggtacttgaaaccagatatcaacctttagatcccatattctttcacctatacattgctctagtccatttcatcctctttggtatgtttttacaaaattttaaaatttacacacacacacacacacacacacacacacacaaacatatatgcccatttaagctgagggaatactagaagttatggatgatctgtataaaggagatgatctttattgaaagagccttaaaattatactgattttttaaaacaaagaataactttattctaatattcgtttaaaactgtacattgatattattttataataatggctgctatagtgtgaacatttacgtccataaggtctgctttggaccctttattagataatttagtaatactaattataataaccaaaggaatgtatttacttctcatggaccagtttaatgtggatgttcgcaccagtaagatgttttcctccatatagtgtgttaaagacccctgttctttccattttatggctgcttcattttctagactctacagctagcagaatgttaaagagacagtggagaaggcatctggttcttaaaaactatggccttgaactggtgcataaccacatctgctgcatttcagcaacaggaaatagtaatcatgtggtcatacctgcttggaagaggactgagatatgtggtctttttcttttctttttttcttttttttttttatgataaccattgttaatattttattaaaagccctcccatacttttccctatggactaatacatatatatattcatgtatgtgtattaggcagggcataatactatacatactattatctaatctgctttatttttcactaaatagcatgtatgaattttttttattatactttaagttctagggtacatgtgcacaacatgcaggtttgtcacatatgtatacatttgccatgttggtgtgctgcacccattaactcgtcatttacattaggtatatctcctaatgctagccctcccccctccccccctccccccaccccacaacaggccctggtgtgtgatgttccccaccctgtgtccaagtgttctcattgttcaattcccacctatgagtgagaacatgcagtgtttggttttctgtccttgcgatagtttgctcagaatgatgatttcagcttcatccatgtccctacaaaggacatgaactcatcctttttatggctgcgtagtattccatggtgtatatgtgccacattttcttaatccagtctatcactggtggacatttgggttggttccaagtctttgctattgtgaatagtgccacagtaaacatatgtgtgcatgtgtctttatagcagcatgatttgtaatcctttgggtatatacccagtaatgggatggctggatcaaatggtatttctagttctagatccttgaggaattgccacactgtcttccacaatggttaaactagtttacagtcccaccaacagtgtaaaagcgttcctatttctctacatcctctccggcacctgttgtttcctgactttttgatgatcgccattctaactggtgtgagatggtatctcattgtggttttgatttgcatttctcttatggccagcgatgatgagcattttttcatgtgtctgttggctgcctaaatgtcttcttttgagaagtgtctgttcatatcctttgcccactttttgatggggttgtttgattttttcttgtaaatttgtttaagttttttgtagattcttcatattagccctttgtcagatgagtagattgtaaaaattttctcccgttctgtaggttgcctgttcactctgataatagtttcttttgctctgcagaagttctttaattagatcccatttgtcaattttggcttttgttgccattgcttttggtgttttagtcatgaagtccttgcccaggcctatgtcctgaagggtattgcctaggttttcttctaggatttttatggttttaggtctaacatttaagtctttaatccatcttgaattaattttagtataagctgtaaggaagggatccagtttcagctctctacatatggctagccagttttcccagcaccatttattaaatagggaattttttccccatttcttgtttttgtcaggtttgtcaaagatcagatggttgtagatgttcaggatacaaaatcaatgtgcaaaaatcacaagcattcctatacaccagtagcagacagagagccaaatcgtgagtgaactcccgttcacaattgcttcaaagagaataaaatacctaggaatccaacttacaagggatgtgaaggacctcttcaaggagaactacataccactgctcagtgaaataaaagaggacacaaacaaatgaaggaagattccatgctcatggatagaaagaatcaataccatgaaaatggccatactgcccaaagtaatttatagattcagtgccatccccatcaagctaccaatgactgtcttcacagaattggaaaaaactactttaaagttcacatgaaaccaaaaaagagcccacattgccaagacaatcctaagccaaaagaacaaagctggaggcatcatgccacctgacttcaaactgtactacaaggctacagtaaccaaaacagcgtggtactggtaccaaaacagagatatagaccaacgaaatggaacagagccctcagagatatgtagtccttttctaggcagttacttcctatcattaactcctccccaaggaatgggaaccgttgataaatagctattcatctgtgcacaaactctatttaaggtagtttattacttttggtattgtttcattatgtggccctgaaatttaatatgttggtgggttttgtgaaatttttattttaattcactgaagtggcaaaataaccaccacactttgttgtgtgccattttgtggtagaacatttgtgtgtgaattctcattgcaatgcagagtatttcttgagtgagaatcaggtctgtgttcacctctagcctctgtaactctctaggtgtgaggccttggagaatcacttaatttctctgagcctgtctttcttcatccataaatcaaggaggttagataatgtgttataatcttcaaaggtccttacaatgttaaaattatatgatatttgagtgacataaattttaaaagtttatagtgacgctttgttttatttatttgtcgctttaattattgtgcttaagaaatacgttatcattttgagttaacagtcctcactaaaagattaaaaatttgctatttgtatttattcaggcctagttaaatttaacagcaacatgaaataaatgattacctgttttagatataatttcataataaggcctctgaaggtcgtttgaaatactgcactaattaacgttttatttccagccttccttaattattctagccagatggtcctttatttatgttattgctagaggtttccagctgaggttgtttgattgttgaagaaaaatatgtgatggcaccataagataattgtaattgaattgttaggtatgttagagcatttgagccttctgtcccggttctatccacatctgggaaataagtttgttaacaaagcactttgacacctcatctgatgcttgagtgagattctgaactgtccagatggaattcaaatggggaaatgactgtgcattttattgtaaaaggcactttgcaaatatctgtgcaaaattcattttgtgaatgaaaagaaaaaaacctttaaaataaagtacacttttaagggcatgatctgttttccaagtgtcataataacttcaggaataaactgttgcattaaggtcaaatttaaaatttgtgcagattaaccaccatttaggaagcagttaagtggagtttttatggcatggaacttcaaaagtgtaaatgaattatcagctgaatagatagtccaataaaagaagcagacttaaagtggaagataaaagtgataaagtgacagtaaattagagaatagaactaaaagctctattgttatgaagaacaacaatagacctgaattatctatgtttctttacaaagtatcttttctcatttctgtgcttatgagttttacaattactaaataaatagtattggatctgaaagcttgtatcagccaagttaggtagaaagccttattaacatggccactggcaacttaatactgggcaattttcctccaagcaaacgtgatttcattattatagtacttaagctgtgcacatgcaggataaatcagttcaatgaccttcttcccaatatgttcaaagatgttgaaatctcagcgtatgcagagctgacacgattggacatgattgttcaacatcttggtaattgagatgctgttttttcaaatcatggaggcattgtttatcttatattgtttatctgatttatatataaataaaattttattggtcagaagactttcataagtcaagttactggttgagtataaggcactaatataattattaatgattatggaggtatcaaatctggatgataatttgatacctaatgaaatggtaaagcaaaacaaataagtaacttccagtggaacgcacacacacatgcacacagatacgtttgaatagaaaagctgaccatgttgatttaaaaagattttcaaagaaactagagaggaaggggattggatctgttgttttgtcttctttttttaaatttcttctatcactttgctttcttttgcccataaaaattaaatggcatacttaagtcacccatcttagaggcactgacttctgctaaataagagaaagagcttatggagtgttgtgttgttcatttttttgtgttttttatgttttattttttccttattgacttgtcccaaagccatttctgtgttttggttcgttgattattcccacttgaataatctctctctgcaggaggctttttgtaccgatcactaaagtaagtctcctaatttataactctgaatatattttaatttgcccattgtggaatatgtgctatctaagaatatctacatgtgcttcaatacatatacttagttctaggcagaatgagagtcaatttgaatgttccgctgacttgctttggaaacacacataactacaagcccttattcagctattggccacgacttagtttataaggggagatcaatgttcctagactctgcatgaattaaaagaaagtgtatgtttgaaaatgtgatccagtctttttattcatgctactagacgtggagtgagagaagagaacaagggctacctattgggtactatgctcactacctgggtgatgggatcattcgtaccctaaacttcagcgtcccgcattagacctatgtaacaaaagcttgcacatatgccccttaaatctaaaataaaagtcgaaattattttaaaaagaaatactaatatcaaaaagaggaaattagtcattactactattgggtttcacttgtaactgacaagtcatttccttttactgctttcaagattttctccttttctttctttggctttcagcaatttaatcacgatgtatctatatgtggatctctatgcatttatcctacttcatgtttgtttagcttcctggatgtgtaggttaacgtttttcaatgaatttgggaatttaaagaaaatgaaaatgtgagcaaggcattcgtgaaactaatacagcttacgagaaattagagagggggatctttacataaccatcttgctagaagttattaaatgtgtttctattgggattaataagaagatgcaatgatacctttggttagtttgctttaattatgtatttcgaagttggctttttctttaccgatgattggttagtgatgaattcatcatccttctatatggcaacagtaaataaatatgatatagagaatttgtaattggccaactaaaagatacttgtagaaaatatatgttagaatgaactgtttagttaactattataataatgaaaacaactgtagtaaccctgtttaaaggatttatgaaatagattataagatttctttgttctatacattaaatgaccattttgttcacaaatttgttatggattgtagtaaatttatgctgcaaagtagactcctaaataattgttagtaaagatttatgcagttttaattttttatataattttacatattttcatagctgtaaaggggattgttagcatttctctatccaaacatacctgccagaaatcagtcattgttgttgttgttattttttttttccattatactgacacagtctaaggaaagttagagggttttctattttgtatttttctcattatgtttgagatgacaaaatcattcatcattctcaattactggaaggcaattcactgaattcaatgtgagttaaaagccagatacctataaaattcttgcactgaccagtaataataagttgtgatgcacattttatccctaacatattaataatatacctattttctattgaattatttctgagatatgccaaaccagtgcaagtgaacattaacggatggcttaaagaatggagaacatatttacgataactagaagaaatggacatattaataacctttactattaatagctagtaaaatgtctttgatcttttttgagggcagcaccttaaagaagcagtatatattcgaggtctcatatactgtaaaagcatcagaatgagtgcataccattctgcatacagtttacttttaagagaacattatatattattaatcctaaaagccattagacaagagaacatttgctgtttatttaaattttacttggataaaaagaatttttctgaggttatcttatgttttaactaaatatttgtcatttattatagatgaattattaagagatttataatgcatgtagattttccttcaatttagtaaaaaggaaagtttattactaatttatgtattgtaagttatgtagtttctagttaaaaactagaactgaagcttttgatttatttttaaataatagtttttatttgtcattgcgtaaaataattacaactcttaaactgtaaactaaatcaataggtaatctaataaatgtaacaattgaaaagacacatttggctggtaagtaaaacccttcagatttatgacattaaatgtaaaggctttcacatgcttttatttttaagctctgatgtgtcacttttcaaaagtgttatattggctgtttacaaatatgcttttatatatgtagctatgcacatgtaagttttcatctgaaattgtcatgtacatttattttggtcatgagtgcctctttgtggctttcagtatgaaatccatactcattagcatctagtacaaggcactaagtgatgtgatcacagtaatctccttaggcctatctctcaatgtgacttcttgccccagattttctcttcaccctaactggctttgctctgaacccaccatggtttttgttttctagatctgtttgcaaactttgcctttccgtttggaatgtttgctaagtcctctgttacccaaaactggcccctattttcaaacaacagtaacaatatccttctgatggacctttagcactctggttatcattgttttctggaaggtcttccattgcatattaaccctcagtccaggctaagtattttctctgtgttctctagcagcctgtgtttacctctgtgatggtcatgctgttatggaatttcctgtttattcatttctctccccaacactctaagctccttgtttgcaaatattgtgtcttatttatctttttatctccaaaacaatcctgcacagtgccctggctcatagcagacacaaaataaatgtttgtttcattagtgtttatcaaacaaaatcactcatgagtttcacctacaaatgcaatcttaaatgtgcctgtgatcacatccttttttatgtgtaacttctggaatcaacaatgtaccatgaatactgatattaaatatgattatctcaggtatctcctgtgagatagtgaaataacccaccatatttgtctctaaaactatgttttatcctcagaactaaatacaatataagcagtctgaaatatatattgaaatctatgcagtctgaaatattcattattgacatttcctgaaaacatggaagtgttttccagttatttgtttgagagactggcattgctgttgtagacagaatggaaatctgtgaatttcttttcttttttttttttgtttttgagatggagtctggctctgtcacccaggctggagtgcagtggcgcgatcttggctcactgcaacctctgcctctcgggttcaagcgattctcctgcctcagcctcccaagtagctgggattaaggcacccgccaccacacctggctattttttgtatttttagtagagacggggttttgccatgttgaccaggctggtctccaactcctgacctcaggtgatccgcccgcctcagcctcccaaagtgcagggattacaggcatgagcaactatcattcccatcattcttcttttctcattgactaatttaaaatgttacctgggaaactgtttaactgttaatggttgccttttacattttttgagtaaaaattgtaattcctttaagtaagacactgtgttttatatagctcctttactgtgcatgttgttggtgtccatgtttagatgagtaatgaaaattattgatgggaaatagggtcatttttattattgctgcagacaagatgtggtggatttaagatgaccacaaattctttgacattactcacaaagaaaggtgacatttatgtcccctccccttgaatctggatggactctaagaaggctttgtccagttgtgtacagtggaaatgatgctgtgccagtttcttagccaagaccttaagagactgacaatttccacttcttgtctcttagagcacttgctcttagaatgtttgttctgggtaggccagctaccatgtattgaagtctgtcttccctgagtgaggaggagtgaaagagggaaaagaggagggagagagaaagatggagagagaccaaggaacaccaggataccagataagtgaatgaagaatgtgaatccatcttggaagtggatttcccagtcctaatttcctcagcggccacaacatgagtcagagatgagctacctatccaagttcttccaagattcctgactcacagtcatgatttaactatgggtatcgttggttaagccattgataaccggaaaaaaagggcgatcactttatacaaataaggaaatttaacatagtttagtctctaatttgtgaatagtacatataaagagtggattgtgaattatatcttgagcgtccttggtaataggcatatgttgccaaaatttctttcatattccttattaattaagtattaaggttattttttcttcatagatcgacatgaacaaagtttgaaggaccctaaggaataaaattttagtaaataaagtagaatgcaagatgatcatctcattctgtgataactacttcttttgaattttgtaacagtttctgtgatatgcatgttgattttttaggcttacttttaccttttgggcaagcccagtcctctgaggtggcagcaagaacaacaagccactacaaatagctagtaatccaagtcaatttcagtttttccatatattaatgaataaaacttaaaataaaacttaaaattaattcaaatgtgaattaatgaaagttctgtttatttatcctaccaatgatcatgtcagatcatgtcagtaggagaagcaaggatactttgagctgttagggtcaatatattttctttaatttataactaagatctttgccctgtaattttatcctttgtctactgcaaaaatttcctccccaaactcctacttgcaccgtgcactaaataggaaaataagcctgaccatatgtgctgctgcccctaaatactctttatttgcacatgagttttctctttattatgttattaacataaatcaggatcccatgaccaggacaactgagattagcacctctactctttggtattagccaggccttctgctatgcttaattgatctccaacagtattattggcccgtttcactgttgtgcttccatgaatgtaactgattctgaattacatgtcattaaaacaaatactttgtaatgtcccctttattagcaagaaatgaaactcatcaccagcatgacttatatatatagctccttaaatcacttcttttcattcaatgttgttttgatataatattaaagagaaaaaaatacttcctggatgaagccagtatctttatagagtttgcacattctccccatatctttatagagtttgcacattctccccatatctgtatgggattctctggctactccagtttattcccacatccaaaagatgtgcatgttaggttcattggcctgtctaaatgatcccaatctgagtaagtatgggtgtgtgtgtgagtgcgccctgcaaagggatagcatcctgtccagggtgggtacctgcgttgctgccccaaggtggataggttctggccacccaccaccctgaactggaataagttggttcgaatatgaatgaatgaatgaatgaataaaatgattgtaaaataaaatttcatgaagtttactatagtcatgcaagtgtatggcagtaaatgatgtggtaggagagtgttcactgacccccaagttgtgattgtttgtttttgaactgagtggtggtaggaggttctccttataattttctcttcacaaacatttattccttgatacatcctaccaccactatgattactgtcactcactgactcaccaaaaattgggtaaatcattatcttacttgttttaattactccttcttaaatatatatatagctcacatttgtttcaatgtttaatattagaagtgtttgaggtctttagttagaagcgatgatgttacataattagaaatataccagaggaaattaactcttgtttatatcaattagcctgcagtaaagttggtttcattatacatcatttcactgaaactcagtttccaaggacatatcaataatgttaggtgaggacttaatatacatgattttaaaaaaatacagtaaaatgtcctaatgtaaaagatacataaaatgaaggtaatttataataaatcaatatatatttaatagctaaatgtttatgtgactgtgctacaaacataacgatgtagttagatgcttgcatctattcatagaattagcagaaatagatggctacagatgctgacaaatagatgcttgttgttttggtgactcatccaccatgggcagcattgcagtacagtgacattttttgaaaggataaatggctcacaataaatttagaaacaaagtgaagggaagtcttctcttaaaatgcacatggcatggcagttgcattcttgaaaaattcagtgttaataactgtgcaaaatgtacttagtatttacataaaaatatagttagggattggatttagataattataaatgggtgagtacttggttagacatttgaatgtcatgcaggagtcacgatggttcacagtggggaaagtatcttgggcattgcaggatctttagaattcccggcccattaaatgccagcccagctgtttccccattcattgtcataacggccacactgacacacacccaagaaatttccattacatccctttgggatgtcacttccaccaattaagaatctttgctttaaacactctcccttttcttctttatcttttctgtttctacccctgtatctttctgacagtacatgtttcctgaattctctggattaatacataaaatgtatcctaactaaacatatcacaaaatgttatcaaacttatgtaataacataattgtaactctttatgaattctcttaccaaatatattctcataaatcttggcatataaatgttaaactataccctatttttaatagtataccttttaactaatattactcatcatattgtataattctcaatttatactgttagtaatttttttcctttttttttttttttttttttttgagatggagtctcgctctgtcgcccaggctggagtgcagtggcgcaatttcggctcactgcaagctctgcctcctggtttcacgccattctcctgcctcagtctcctgagtagctaggactacaggcacctgccaccatgcctggctaattttttgtatttttagtagagacggggaatttttttccttttatatctatatatgagtctactcatttgtaataatacaaaaccccttaaaggaaagagcacatttttgtatttaggggtctcttacccaaaatagatggatatatgtatataatatttattatatttgttgaatgaatgaaaaatagactattctattagtatccttcttctgtggataattatgagtcttggaggtttcaaccttttttagtgataggaataatttgataaacttttaagcaatttgtttcaaattagcagcattctccactgaaggagggagagttccagggggtatagtatcctccctatctggtcaggaggatatcagttcaggcaccagcttggagtgtaaagcacactagtgaggtaaaggtatttattccctctgcctcttccctgtagagttgcctcaagctggctgtgtcctttgctgtaaggtcagagtttttctcaaggtagccatctgtatcagtccattctcatattgctaataaagacatacttgagactgggtaatttataaaggaacaagtttaattgaaacacagttcagcatggctgtggcggcctcgggaaacttacagtcatggcagaaggggaagaaaacacattcttcttcatatggtggcagcaaggagaagaatgagagctgggccatgggggaagccccttataaaaccataagctctcataagaatgtactcactatcaggagaataacatgggggaaactgccccatgatttaattgtgatgggtgtctcccatcacacatagggattatgggaactacagttcaagatgagatttgggtggggacacagccaaaacatatcaccatctctacacaacattctcctctggcttctaataaccttccctccttttctctttttggcttgtggagggtcctacacaacccaatatagtttccctgcactctgcccacacctttgtaaataatccttttgtgaaccttcctcaaattatcctaatttgaatgtgtcatctctttcctcttaggcactgactgatataacccccaggcacagttaattatctgcttggtgtttccatgacattgtgcatatagctcctttattcatttctttattacataattcagcatatatttattgtgcatccactaagtgtcaggcagtctcctgggcccacaaggaaaatatatccatgtaagttatgccagcattagttaggcagttgtatgctatttaatgttatttaatgtaatgttatttacattacattatttaatgtattgtaatacagttatttatgcagttattgtaatgcagttatttaatgtaatgagtcctacacatacagaagtctatagtgctatggaacttcataaaaaaggttcataacttacacataatcattggagacattgtctcaaagaatgtgaaatccaagctgagaccagaaaagtgagtaagaattagacccgcagagagggctgacagtgagaagggaatgttccagctcaagaaaaacatacttacaaaaccaaaaaaggaagacatggcatatttgagtaatgaaaggtaacagatgatgtgtttatgacgagtgagggtgtgtcaagagatcgttctggagaatatgggtcagattataaaggacattgtaaactgtgctaagaagtttacctttattctaatgaggatccactgaagcaagaagcatgacatgaacaggttgtaactttggaaatgttattctgattagttgtagagcataggtaagaggagaataagaatggagggagggagactgtatgtatggtcatgatagggggacgaaccaatgtatattcacctggtggggaagaagaagagtaatcagatttcagagagattttacagatagcacctacaagacagagtaatttactggtatttgggggtctgaatccctaattctaaagacggtgggagatttcaagcctaaacctccaagtttatgaccaggcaactagttggcttgtagtgatagtcaacgaaatagagaaggtgaactgtgagcaagttttggaggaaaaaccatgaaggcagcaatagataaatctaagtggaggtgtgtagtaattatatagataagtgggcttgagttttatgagacagatgaggattggtagtatggttttagaagtcatcaacataagctgaccattaaagcaaaggagataagatgaagcagtgggggcagtaagtcagaatatgattgtatcatattctaaggcaaggatattttaagaacgcttcaggatgacacctaagtaaggactgagaagggctcagagaaagaaatgaacagggtgacaaaccttgattgagacagtttccatgataaggtggggaagaaagcctagattagagaagtaagagatgagaaagtagagtgagtaaaaataactctttcaagtatttttttccctgaaagagaagagaaaggattttagttttggtaaatatggtggtggctcaggggcatcgattgcatgcatgcatgcatttacatatgtaagtacacatatgaatatgtaggattctatgtatgttaatgggagtatcttaaagtggtttaaatgctgatggagacaggcactagggagtggattaaaggtatagggaaatgaaataatcattagattcagatttaggggaaggtaggataggaacaatatcattattatcaatgtatattgttctttcttactagcttgatccctaaaaaggcaaagactatattttttttgtatcctcagcatctaagacattacctagagaatactgggatcttctatattttagttttaggaaaaaggaataatagcttgctaaaataaaatagttaatttacctcagaactcttccaagatcctcagccaacatttgcattatatcctaccttcaaaaactgtcaaacgtatgtcctttaggtattttatgcatagaaatgttttttaaatgatcccttttggacattaaataacagttttaataattttgaattagtactaagtgccatttaagtgttctcctgatatatactaaatgaaaacagaaaatgatgcatgggagaaatgagttagatcaatatggttaaatttaataaaattcaaattaaagaatctacattatttctatggtgatatcactatgatatgtgataataactccctcaatgtataagttccagtcagaagatgattatgtgcagaaagcttttgcttttgtgaccctatatctcacctgttcttttttattgattgattatatttgaagagactcaaatctgtttacattagattaggctatataccagccacgtgattttctgtcatactaaaatttcaaacttaagatcagaagtaatctagattctataataaaaaatcatgacatatgctatggagcttggctgtgactcaattaaaattgcattttttttattatactttaagttttagagtacatgtgcacaacgtgcaggttagttacatatgtatacctgtgccaggttggtgtgctgcacccattacctcgttatttaacacgaggtatatctcctaatgctatccctcccccctcccccctcctcccaccccacaacaggccccagtgtgcgatgttccccttcctgtgtccatgtgtcctcattgttcaattcccacctatgagtgagaacatgcagtgtttggttttttgtccttgcaatactttgctgagaatgatggtttccagcttcatccatgtccctacaaaggacatgaactcatcattttttatggctgcatagtattccatggtgtatatgtgccacattttcttaatccagtctatcattgttggacatttggcttggttccaagtctttgctattgtgaatagtgccgcaataaacatatgtgtgcatgtgtctttatagataccatctcacaccagttcgaatggtgatcattaaaaagtcaggaaacaacaggtgctggagaggatgtggagaaataggaacacttttacactgttggtgggactgtaaactagttcaaccattgtggaagtcagtgtggcgattcctcagggatctagaactagaaataccatttgacccagcaatcccattactggttatatacccaaaattaaattttatctaattatgttggtggtagtcagatgtgtactctttgaccagttacctgtagccaatttgtcacactttctttctgaaacttattgaatagtttttaaaagatattttatcttttgagaatttttggtaaaatgcttagttggcaataacatctgatttatgaatttatatgatatccctcataatagaatttcaaaatacattttaaaaattactttttaatgatagaaggcaaattccacctatctgatcattccaaaggcagaattattaatttgatggcaaattgattttcatatattataaaaaatgatgctccaaatagaaaagttttacttaaaatcataataattttgccattgatcttatacaaactttaaaatccatatgttcaaagtacttaagggaaaaaggaagtagttgatatatccttgacatctgctgctaaaaattagattactttgtattcgcatttaaagtaaacaatgttaaacatggaaactatcaagtgaagaaatatgtactgttatctcttctgaagagttattcaaatttttattgttatataaattaaaatttagtgtaattttaaaaactcgttttctctttgtaactggttagtatatgccaaggcctgtgttaagtgctcaatatacattatattatttaatttatgcaatactatgaattattattatttccacttatccagtgagtaaactgaggttcaaagaatttagataacttgatatgctcacaggctagtaactaggcaaaacatggattcaaatttgggtttctgtgacttgaaagctcatacactagacccttactatgtatattataatttcagccatttgcaacatttttactatactttaaatgtaatatttgtgcatacataatataataggctatatttgtttatatatcttaaatgcattaaaagaatatgtggtacctgttactgtgcttagaacagctgtaggaattatgatttacaagcatgtataatatgctatctacctttcattctgcttggaaaaggatgacatatatgagtaaaatagtgagtgatatcatccaaattgtatgatatacattatcatataatagtataatatacgaaaagtgtgtgttagaggcagcaaatcctataggagttttgttaaaaatgagttcaatgtagtcatatgtcatcaagtagaactttttgggggagatgaggactaaacatggatggatgccaaaaaatcgcattggcttgtgtacacacaaactggacctgctgagatccatctgctttaggattaaggttcctctaaaactgaagagcgtcatgaattttctggttctgaaaatacttttagcacagtggccccatgaatctctatgccctgtgactgctttatattactccgatgtagccaaagaagtttacttggaattctagcacctgcctttgctcattggcaaatcccactgcttgacccataccattttcccacagctcccactttacctgagttttgtcctggacggtctgtcccaccatgctctcacctaaatccagccttcctacaatagcatccttccttgattcctgttctcattgagactaccttcctggcccctttgccagtgttctccgctaaagagatgttccccacagcttctgtggctggcttctccagaactttctaactccctataccaatctgtaggaagcctcacagtcagtattatgctgtgttctccatggctgagtcagatattcagaacgtgtgttttaaaagtagtaacagcttcaccatagcaaaagcatagcaaagaaaggcagtaaatcctgacacaattatgaatctcaaatgtattctttcttgctgtgctattagatatgagcaataatagtttataaggatatatgtaggcttttgataatttctatttttaatttgctatgaataatatatatgtgaaaagaaaatatttgtgttcaagatgagtcagtattttgcttattaaatatatgtcctatcacggtgtataaataagcataccactttgaaacaattaaatgttttgcaataaaataaaattcagatataaaatagttacacatttttcaaattagtctatttttatcaaggtttataatcactttccagtacatgaaaattatcatataaataatttaatagaagactctgctctcttcacatttcaaagtttattttttaggtatagaaaaaaatcaatattttttttctcattttcactcctagaattagaatccaaatcatttttaggtatttcttttaatgcttacttttaaatttacctaactgtaattttatccagcggtgaaaatctacaggatcagggtcaccttgccctgtgtcaagctattccacttcttaactgtctctgtacttaaaaatctatgtcatttgatattaaattctgagtttgtgtttatttaattttaaagccaaagataaaatagttcaacacaggaacattatcccagaaatgttgttactacctggtcatttggccactgaaactgaagaccagatgggaaaacatctaatggtttctcattaatacagagaatgtagttcaatagaagaggcaatatgtttgttgttgtggccagcattaaaataaaagtaatcaagaaggtaaagactactgatgtaggttgggagacaggagttggggagagggatttagtcactatgtttaatagaaatatataacagagtcattgattattaaactatgaagatatttaaagatcactaatacaaactcctcactttcctagaaaaaattgaggcacaaagaaggtaagtggcttaacccagtataatccaaaaaattaataattaaccaagactaggatatcatctcgtgactttcagtcagtactcttttggcctttgaaaaaatacagacctgcgtaagtatttatatgcaccaatatttggagaaaatatataaggaggaagacgagagggaagaagaggcagatgacgaggaggaagaagaagaaatccatgaaaaagctactgagaatcagtgaatacttctaataaaaaatggacaccaatttaaatctgttgctatctggaaattctctttcttcaccacatatatttaagaattactaaataaatgttagaaatcaagcaaaaacataacttgtgactccccttgagtcacagtttgaccactgttgctcatccagggcaacctgtgaagagtcattatctagaaagattcgcctgaataaggcagacattggaccaaagcagcctcaccctatgactaggactcgatttcagtaagttgtgtttcctgtatatttttgttcagaaagtggtacctgttcctcactggtctatcagactcattaaatgttaaggattcttaaatgggttgtaactttgaggcatcttctcttttgcagttttggttttgtttctttgcttaggtttcagggtgaaaagttgatgaaaataacattggtatggtaatttgattatgataaatataaataaaggttagatgttctaagacatagttaaattcaaaggacacctgtaagaaagtggaaagatagctgtaaaaagtttcactgacaaaaatatagattctttctcaagcctcatattcagaaattctgatgtaggaatatacaattttaaaagaaacttccagagtattttaaaggtcgtccaaggtttgaaaaacactgacttacactgtctaaatattggctgttatgattaactgataaagtttatattcaattcattgtgtatcatgttttgactagtttattgttgcttttatgtgtttgtttatgcttttactctgtgtttggattattcatagcttccttaacacccattaccgtagtttattgagagttggctcggttgctttggaaagctatatttctgcaattctacaactccatacttttgtaattaaaatagagttcagacttattatttggaactacctttaggggtaactggcaaaacacataaagaaattagcctcactgctatagctatgcctcatattttttccccaaaaagatatctagatctgagccttccaatatgacagccactggcaacatatggctatttaaagttagttaaaattaaatacaatttaaaatctagttccccagtcataccagcatcatatcaaatcctcagtaggcacagtaaatacttggtatttaacctctcaatattaaacagcataaatataaagcaaaaagttctattggacagcactcatctagaatgaccacctaccctattcacaagactagtctgtagaacttttaattatttgcaatacttaaatccacttttaaagggtaaaagaatttgccaacactaaagatagtcaaataattttgccataggatctaagggaggggacagtgctcgtattttgagcaatatctcaaatacatgcagtttagggactgtggatgactatagatgaatagcacagcttttatatgaatatgtacattttggtagtgtaccaggtatattctgcctgcccctccaggtccactcttcactgctgtctaccctgctctctgccccagaagctgactgtagttactatgccaatggacttccttacactttgtcttccagtaggtttggtatggagtatgagatcaggatattgtctcccactcccttctaaaaaggtctcaaaggctgactgcactgcacaacccaaggtatatcagttatctattgtggtgtaacgaactatctcaaaatttaatgacttaaaacaacaataatgtattcattctcacaatttgatgggttttctgcgttaataagtaatctaagaagttcctcttttccatgttttgttggcttatgcgattacattgaacagggaggtctgcttaagtcagaacctgtctggcatctcagttggagtagctagaacagctcagggtggctgatcttttctctatatattacagttgaatgacactacatcattgctcaggggttcaagaggaggaaagtacaagtttctagacctctgaaagtctaggcctggaactggtccagcattacatccacaacattacatctactgcatcttttttttttttcctcctttgagatagggtcttgctctgtcacccaggctggagtgcagtggtgtgatcatgactcagtgcagcctgaaactcccgggggctcaagtgatcctcctaccttagcctccccagtagctgggactacaggtgtgggctaccatgaccagctaattttttaattactatttttttagtagaggtgtggtctcactatgttgcccaggcttgtctcaaatccctgggctcaagcaatcagcctgcctctgcctcccaaagtgctgggattacaggtgtgagccaccacacctggaccatcactgcattttatcagccaaagcaagtcatgaatcaacttagtttcaaaggatggagatgagacttgatgggagaagcagcatgcacctacaaatacaggagggattgctggtagccatatccaccattgaaaatcacagattctgtctagggacctttctccatgactttcttgcttttgatttcttggtaaccacttgttccccttacccctccaagcttaggggtggtgtgactccccggttcttacgaatccctacacactgaattacaccttgtgaatttcctatgcctgtttaccccagtggggtaacttcaaaatacctgaatggagaattattttcctgcttgatcctgtttcatctattctcaaaaattagttatgttgctttatcttactaccttatacctgaaattgttcacaatattctattaatttttttgtagcaatcataaagcatttaaaattttcctttacccagttagctttacatttagtctttatgatttcttacattaggatttaatcttgatggagaatgaatattaagtttaactaacatatctgtaagccattatttcaaaatgaaatcttctgattttggtaacatctgcaacctccagtgaccagacctacagtctttaactgtatgactcagttctgtgttctgtgttcagtatcaatgtcagtagtgtactaaaatgtccattttttctctaggattacataaatcttttacatttgtgtcttaaacaggtcaccaagcatttaactttaacctttttatatcatttatgttcaatagaattcactacttttactactctcatcagtgcttgtcttctgacttattaataaattaatgagcttgttttaacaattgaaatttaaaccagatggtcatatgattactcagtgttttcaggatcgaggattttaaaaactaaatgtcattattcccctcagacatactgatttcttgatattaaattattttaaggtttatagaactagatccagaaaaaaatgcttcgtattgtagaaggaagagagctttccatctttaatttacctaaagtggttttccaaatgattatatgtaaatatctgacaccacattgttttcttttataatttatttttgattctgcttaaagaaatacaaggctttagcaaatttaaagtggtccactaccccaagacttaagaaaacatttatactaaacaaatttaacaatgtatatgtcatatcaactgaaaatctgaatttttacttttttgctcatttttctgacagaatatgatagctgtctgaaggatatgtaatatttataaatgggatatagcagatacaacctgttaatatgatatacactagagttagagtatatctagatatagaaatactagatttgtaatattgagaccacattactgtgatatttcattgcagctataataaatttttatgacttatcataaggtaaatgccaactttgcaacatgtatctttttttctttgcaactgacattctatgttcagattcattgtgctcctgatatattcccatcatttcctttcctgggagaatccctttcttgtgaactacagtgacttttttattgacatactgcaagtgcagaagctttccaacaaagcattgctttgtaacagtagaccaggtacattctgctaagcaataaatcatgtatatattcactggagcacaaaaatattttggtgatataccaggtaaaaattgatattctagtagggagattttgattaaatgccctttcttctacaactttggtcaaatttcaggtgtttaattcccatatatgatgatgtttgtgaacttcaatatacattgttatgtttttcacctgaattcccagctgaatgtaaaaactgagaacaagaaaaggtgttattacttagaggtgtttttaacagctctccaatttcataacttgtcatttcccttttctttgatttagaaatgtgttatactcctggaagttttcacatttgatagatgtaaaaaatagaatactttgagagggattatactagcatagtggttaagagctcagactctggagccagagaactgggttttacatttcatctgtttcttacttgcttttaacactgtacatgttaatgtctcaatgcctcagtttcttcatctttaaaatggaaataatatccatatacatagggatagtcatactttatacagttatggtgaggattaagagttaatatatgtgtagtgcttaaaaagtggctgtcatataataaattctatgtgtttgctatcattgttgctattgaaagacaatgaaagcacatttgctcatttaattagttccagtcattgttattaatgtatttcatttcatttttcctgcagtgaaaaagaatgcaatggatccttttgccattatttaacattttaagttgcatttttaagtttatatataatgtattctacaatatttcacaatatatgagatattgggactttaataataacttgtgtgagtaatgtctctagtcttaaagactctaacactatcttaaccaggcaaagtaaaacactgtcttaactactgagcaagtagtctctttgaaatcagcccattttgtggatgccatatacatgttacactttaaagcatataaggttgatactttactctttctcaacattgattagagactaagaccttgttttgactataaaatatatttctttaagagggagaaggagacagtgccctgtgtttcagtgaggtatggaacacctgagttcaggtcaaggtcactgccatttacttgctatgttgatctcttacctttgtgactcacagtttctttatcagctaattctgtgattagtataaaaatcaaatatgagaaataatgtcgaaacactttagatgctgaaaatattacagaaataaaaagcagtgttattgaagccactgtacctttatcctgctgaagaggttaaggattaaattggttttgaatatatattctgtggtagtggggttggagcattgcagaacatgctgatgcacatgcttagggagagggacaatgatttctagccaagtgtcagaaggactgtgtggtcgtgaaacacaggctgcatttggcagaagtgatccaagctagaggtcagatcagtggtgtccaaaagatgatttagaagtcttctttttgcccaaagccttttgatgaatttcctatcaagtatttttctaagaactgttaataaatgtcaaaattaacagatttcagttgtatctccttttcatcctgactctgcaagatagactccagaatatagcctaaaggaaagagaagaaaagaaaaagtaatggatagagtagatgcttctaatataaaagatttccaataggctgagtgctatataagaaaaaggaaaaatatttgatatttttaactaacatttattgcgctacacattttgatagcattccaatgatgattcgacctgccttgtctttgagattcttcaactagttgaggaaagacatctatcaaggaaagtatctacatttctcctgaagctatctgaaagagttccactgtttccctaatcaggttgttaggtaaggacaaagatgagagcatgagtaatagaatttgtggggtaggtgagggcagccagaccactgcctcggcagggaacaatttgggcagcctccaaaggaaagggatctttgaggcaagagatttaaagaaggttttttacgaagtttgtttgtaagtaatgtacccttctcttcttatcccaagaaagcgtcactgaacttctgtatttcatttcagtccatttgagttgaagttgtgggtatttagagttatttttggatatgatattatcttgagactgcccataaggtgagagaaacaagatgtcccaataaattttgcatacagatttataaagaaataaacaaaatacagggacactgccactagatttttacataatattcactttaaataacattttaattgtaaatatttttggtcacgacctctaaacaagtcaataattgaaagaaaaacaaataacataattgtatataacacattgtacttttaatgataaaaacaacaattacgactaccatttatatatgcccagccaggaaatattctagatgtctttatatgatctaaccctaacagtaacttgaaacatggtagatgttgatagcctcatttttaatattagaaaaaggaagctcaggggttaagtgacttgccctagattaaacagcctaggaagttgcagagctggaatttcaattgaggttgcctccgaagcctattctttttccaacttattgtattccttttgaaagaacacaacttattttaggaattactcatagaagcatctcctgttaattcgatatttatagtctcataaattgaatcctaaattatagcgttttagaacataatatataaaaaaagtggaaaacatttcgactggtgcaaagaaaatgattaagaggataaaaatagcccaaggcaatagtattaagttaggcaaacgtaagctgaatgttgagaagttaagaatataggcttcttagatttcgattttcaaagtaataacttttcttattacagaaattgttttttatgtatggtgcttattactaaaaaaagattaattatctgtcattcatgtcaccaacttactaagttgttacattggccaatttttgtctttcttaaattattttttatctcatgtttctatctcatttgggggaaagaagaaaaaaggcaaaagaaattcctttctgaatatccatacacattgaagttttatgttcatagtaaactaataactatttcttcagtgtatgacgttatagtattttttcctccaccctcaccacaccttgttttagcaacttagttcattgccaaatcctgccacacctccctttattccactcccatatccaatccagctcatcttttatcgtactgattttaggaatgaatatggtccccttatttaccaaaaggtgtctcagaagttcgtgttgtttcctagtgttcattaaagcttgcagatattgaagtgtcaccagggcattctgatggagatgcccagcaggtgtttgagattgtccctgggaggtcagaatttaggattctatttaagacagtagtttcaaatctgagtgatataatggctctcctttaagagaagtaaaaataagaaatctgcaaaagacattattttattctttttcatggctgtgtagtatttcatggtatatatgtaccacattttcttcttccagtctaccattgataggcaactggccccatgagcatcttgcaaatcccagagtcagaagcaactacagtaagagctggcatgtaagggttgctgaactgcaatatcagacaggcatttgagtctcagtgacagcagcattttctagaaaacagtggtatctccattggtaaagatgattggaatggtgggagagacacttcttatgaaccagtaatttctaagccaagtacagtaatgttaagttcaagaactatatgcaaccaaacactagataatataaaagtaaagcaaattaatataaccaacttcaacatctgtgacagtttgtgttttccagtgatgaccacaatatctcctatcccatatattcttctgtaatgtgactttgctccttccccataaacaggtagtcttattcccctctttttgaatgtggactgaccttaccaactcatttataaccattggaatggaaaagaattcatgtgtgttccttccaaggctagatcagaagacgtgtagcttcttccttagtgtactgttctggaacactgactctctggaaaattcccgctcagcatgcttcctcttgggagctgccatgctgtcagaaccccaggctacataaaaaggctacgagccagcactacacttaatacatccaactgggcccagcctccaagtcatcccaactcaggtgctagacttatgagtgaaggtctttatgtgcaaaggagaaagcaaagagatctttgatgaccagaagaaatatattgccacagagacaataatgcttaccaaatattctatgcacacactcacatttttttaggccccttgcagttatttgaggccaagtaattattcttggagagtgagctatgagtagcatgataaatgtcacttcccaaccataacagagaagatcaggtatgaataaacatgacatttctgatgtcggagctttagatagcctagatccttaagtcactatgtggaagagaaagccctgccaacctctgttagacatcatgtagtgtaagtgaaaaacagacattcttatactactgagattttggagttattttactacctggcctattcttgaataatatactttcttcatttttaaaaaattccattttacttaatcattgatttattacacttactgagttcctactgcatgtcagctacatcctgggaatagaaagatgaataagatgtagtcccagttctcaaggacctccgagtctactgatgaaatttttgtaagtacttaactgtgtatttgcccatttatagactttcttcaaaagagatcttcttggaaaattcaaattatttagcctggaatgcaaagcctttcaaatctgattttacttgtcatacatgtattatttttcacaaattccaaccacaccacatctcacttttctaaaaaaatggactgtatttctagaccactgtgattcttgcatatgctagcaactttgcataaaatgacataaattatctctgttcataaaaattcaacccagcctttataacccagttaaaataccacatctttatgaaatatgtcatgactgtatcaccaaatatgatacatttctctcctaaaaccttagtgatagtgtgttcatttcttttaactctgtctccactagactgtgggttccttgaaaacaagaactacttgcttatttctgctgaacctacacacagtctagaatgcatttaaaatctcatgtttagctgcacatggtggctcatgcctgtaattgtagcagtttaggaggcctaggtgggaggattgcttgaagccaggaattggagacagcctgggaaagatagcaaaacctaatctatacagaaactaaaaagattagcctgtagtcctagctagttgggaggctgagagtggaggatctcatgagcccaggagtttaaggtttcagtgagctatgattgtgcgactgcacactccagctccagcctgggcaacagagcaagaccctgtctcttacaaaagaagaagaagaaggagaagaagaacaagaagtggaagagaaagagaaagaagaaaagaagaagaaaagttcattttctgtcatggggtatattatttatctgcttaagccaaacagacattttaggagcttctgtcttgccttatgttcttgcttgtctagaaatacattgtaatgaagttccttttaacagatatttctctaggcatgctatcttccaaagttcagtgttcattttattcactgcagttatttttattacagcaaataagaacggaaaaatgcaaaaggccataggacttctactcgggtacccactgtggttacatacctggcaagatgttgttaataatggtgtaatagctaacatttatgagtgctactgtgtgccagatagtcttttacatactttacatatattcaatttaattcttataacaaccttattaaatagcttattattatgctcatatcttaaagatgaagcatgaagaaagctcaaaaagctagtgagctagaaaacagtaagtcgagatcgcaggaatccaggccgtctgtctccagagctgtgctggcaatgctctcagcaagaaaggaagttccaagccctttgtagttgttcctaaataacaccgggcaaaattttgcaaatcaatctatctggaaagaaaatctaatagtcgtttcagtgactattaaacaataacaaaaagttaacagtccatataattatagtttcctaaggataattcttattgttagatgaaatttactctagcatatgaaaccatatacagtgacaataagggaaggatgttgtgatgcacaaaactttaatcacaaaaactaaagaaagcaagtttctcagtaatcatggctggagaaaacaaaaagaactttcaaagatattgtacattttactagagatcgaccatagcttaactcattaaagaaaacagttaataatacttctagagaagtacatgtttattcagcaataccttggcataaccatctgcaatacatgtcttatatgcaaaatttagtagaattatttactcagttatctaaataattctaatccacatgcaacttcactttccaaatgagaaaaaatagcagattagttatatataatttggagtgagtgactgagatctctgtctatgtatgtatatctgtattatctacaactgtatctgtatatgtatatatatatatatttatgattcagtaagtatgcagttaagaacacaattctgaactttctaacatctaatgtctaatttatgctgtgtcaaatgtatttttttaaaaaaagataaaaggcaaacataagtcaggggaaaggagcatagagtggagggggaaagaaaaaagagtaacagtggagaaagacggacaggaaaaggataaacaagcagagcaggatggctgattacttacagcatgtgctgaatggagacactcacaggaaacatcatgtcagatatgcttaaatatcgaacttatttctgagtttgtgttttttctgctacacccatgaccaatgtctcagttaaagaaagtagagacaaaagacaaatgcttaaatttcctgatacatacctcttatttacagtacttcttccattgctgtacttgtttttatttctggcagctttatttgcttatttctgagtacccagcataatgtcttacatatagtacacatttggttaatatctgttgaataaatgcattcatgaaagaatgaataaaagaaaacaagtcgatagagggctattgatgtgtgtacatagtctcatgggctaaaagctctaaatgcaaatataaggggttccaggaatttcagggctgctccatgaaaaagatatggccacaggtagaggtagcatacataagctttattttgctaacactttgacaggtttgatacaggaaaatccctcacagcatggaactgtccagaagttactgcatgagagccaccattcagaaggggaggacagcaagtgatatggtttggctgtgcccccacccaaatctcaacttgaattgtctctcccagaattcccacgtgttgtgggagggacccagggggaggtaattgaatcatgggggcttgtctttcccatgctagtctcatgatagtgaacaagtctcacgagatctgatgggtttatcaggggtttctgcttttgcttcttcctcatttttcttttgctgccgccatgtaagaagtgccttttgcctcccgccatgattctgaggcctccctagctatatgggactgtaagtccaattaaacctctttttctttccagtctcggatatgtctttatcagcaacgtgaaaacagactaatagagcaaggaaactcccagaggagggagagaatagggagggggcttacctatctaggtgatgttcctcggcagcaccacattgagtctctgcatcagagagctccaaagggtatcagtggcttggcatatatatagcccaggtgctatctatagcctggggccagcagatatcgggcatagtttcatggggtatgcaaagtaggctgtttgtaactatttaaatatctacttatttagtctatgttgaaaacatagtgaaacgaatgaaaatttgagtttggtatgggtttacttttggactaccaggtctcagcctgctgtgaagaaataaacaatctatggaccaatatacaggagccatctttggctgatttatataacagtaaataagcatgatataaaaaataataattcaacaaagagaggaagtgagtttattggtttttaccaagcattatttcatatactaaatttcttcaggcacatcaagctaaaacattatattaagaaacaggtttacaccactgtacatgtgcaaaaattaaggatcatttctatgatttaactaatataagtacaattgaacaataaataccaatctctataggttaagaaataaactacgaatctttttataaaattgattatgaaatgaactctcccacttttgttattattttaaaaatttatgtggagtagttaaaatgaattaaactccgaagaaaagtaaatcatcattacattttcttttattaccactttgctcattaggaaaactcagttctggcttctgttttgggaaacagtttgtaactgtgtttaatatcatttgaatatctataatcattcttatgcaaatagcatgataataagtattaacattaaagacagaagtttatatttgtcttatattatctgtccccttccaaaaggaacttaaatcttaagtcaaatgctgtaagtgcatgtaggttatttatatcatttctgtcactaaaggtgtcatatgcatatcatagatgccagcaagggagaacaaaccaaaagtcctatccagtcactgcagctggctcaagtttagaaatctggtcatataatgtagtctgcacattatgttctgacttgggtttcttggtcctgagacctaggaactgataaaagaaagtatctcctcactccaaacccaatagacaatggtggaagaggaataagttaaacagtgtaaaccctccattcaaaaatgggaaaaatagcaggcaccattaggcatagtctgcaagcattttggaaatccactgtgcagtagttgtaaaagtgaaggatcctgatgcctgggaggaggtccttctcttactatttcctggaatccctgcatggcatgtactctctggaaggtacttcttttccattatcctctttggccatatctgaagtatgtgtgacggaatatgccttacttgggggcttcagtgaaggcttttcttcctacttcctgcttaaagcaagttggtagcccaagtgtaattttaagtcttgaacagtactagtttttgtttgtttggttggttggttggttttttttttaattccaggtttgttgttccttttgcagtacaaccctctctgaaactcactgggcttcttatctgtttgattacagtgagtcctatgtgccaattaccctgcctgcaggttttttttagagatgttattctcagatctgctgtattgctttgctttctctccgcatacttcactctctagactcagtgagagctacattgggactatctgacttctgcagaaaggttgttttcattctgatctctaccctgagtcattttatccagttgaaatgttttggggtaataacccctaatttgatatttgccctgagacatcatagtgagctcaacaattgtaacaataggcatgaaggctatacctttaatcatatctttgatactgattaaattttaatgggcctctgtcattcaaagtcttcctcagctatatttcttactgtttagggcctttagtagttagcttttccaaaattgcaaggcctcaaatttttggactctctgaattccatttcatttctctttgcaaactgacattactttttgattaaaggtctttccttaataccctgttaaaagtagtcaacatactctactaatattctattttccattatcttctcctagaacttaaacacatgagatatgtgatctgtctcccactttatcaaagacaacatttaaccaaatgtttttgtactgcataacatagattgctagctcttcagcttccagtatcaattttctcataatctgcctgctaagtcaatgccacagagtttaggtttttgtaacagcagcgctctactcctgataccaatttctggactagtctagataggctttgttatgctgtgatggcaaattaaccctgaaatatcaatggctttatatgaaaagtgtttatttctcacttctaaggcatatctaagacagatcagcaaagggtctctcttccatctagttactcagagacctaggctaacagaagagccacatctagatcctcactggtcaccaaagcagatgtagagagagtacctggagagttgacatcttctctgctttggcccagaaataatagatgttatttccactcagtttattggcaaaattagttacatggccctgcctaatttcaagatgcctagtaactataggggatcatatgaaatatttggtgagcattgcagtctcttctacagagaaaactcttaaagtatatgcagttatgaaaagtctatgtaaattaacggctgtatgtatttgctaaggctgtagttccagagctattagaaatcctgagctttgtagtcttggaagactagaccagataaacaaaactaattcttctttcaatgggttaataatgtatttatcaaacacattaaggaatgatatggacaaaaattttaaagtaagttcaagaaagagatgtattgaaagcaatagctatatatatagcaagtggactatagaaaacaagtggtatccttgaagtgtatccttgagctttggaaagataatcatgtgaataccatgctctttaacagggagacacttgggacatttattagactgaatgatgggcttgagagaacacttgtctgacctggtattgcactttttgtgtttcaggagaaatgatttatacctatagtgtatccatatttgaagtctagtgtggttctgctttagttggcagtctatgaataatatccttttttaaactatcaaaatttacattacgtacctctttccagacatgtggaatgggattctactattactagggaatggattatgatgaatacatcttctcatgtacaaaatagaaggatttaaaatataactttgaatgtcaattaataggattattaaaaatagatttgtttggtccttctatgtcatgtgttaattagaggctaagtccttgaaaagttaatagatcaaaattaatacagagtaagtattggacaaagtcactgtaataataatgctattcattgagttatcacataaagacttttacgtgtgttatctcatttatttctcataataatccagtgaggcagtaaaattattatccccactttaaagatgtcaaaactgatagcagtaggttcagcagctgacccagtgtcacacaaaaagtagcaggactggtattcaaacccaagcagtctgactccagaagaccacattcttaattccaactgtatactagtatccttccgtttgatagaaggttgtgtttttattagatcatcaaattgaaccatctcaagagtgtatttgtgttgttagagtgtaactcagtagttatcatgtcataatcaactgaggggaattcttcaagctacatagatctttttcctgctcttctcccttgcatcacagtcagtcattcattctcacatgtttacctgggtgaatatataactaaaaaagaactttcatgtaattttaatacaccatcccacccaccacttctttttgagaaccactgctcttggttatattggtaactgtttttgctgtgtaaggagaaaggtgacatgtgaaagaaatataggtaattttttctgaaacacattaccataaattgatcctgagatacaatgcagtggttaaaagtaaaggattcatggtcaaacaaggtgttaacttggtgtgcagccctttattgttgtagtgatttttttagactgttttagacttgatagaggtctaataccagttcttactctagctgtgaaaataaaactctgttggattttcctttcttgttctctttgattagcaggatagataaactgaacacaagtctcaccctagctccacaacttactgtgtgaatttaggcaaattgccttaggatcctgtgcctttgtttcctaatctgtgaaacagaaaaaaaggaatatgggccaggcatggtggctcacacctgtaatcccagcactttgggaggccaaggtggatggatcacttgaggtcaggggttcgaaaccagcctggccaacatggtgaaccccatctctactaaaaatacaaaaattagctggcattgtggtgggttcctgtaatcccagcgacttggggggctggtacaggagaattgcttaaacctggttgggggacagaggctgcagtgagccaagatcgcaccactgcactccaccttgggcaacagagtgagatgccatctcaaacaaaacgaacaaacaaacaaaaaggaatatgtacttgatatgttgctgtgggaaccaaataatgcctatttgtaaactgtatagaaatgtgcccattttatagtaaacactcaatagataatacatatgatgatgatgatgatgatgatgatgatgatagaagagccagccagttccctacctttatgctcttgtgctcccaccagtggaaatctccctctaaaggaacaaaacagttgacaactgctagctcttagaagctgtagacctctaagtcaaagtttcatcaagaaactacatttttaagtatcacaacagaagcagtattaggaaagagattaaaggcacagaatctagactgagattacttggatttgaattctggttctgccttttctagctatgtaactttaagcaagttacgtattctctcagagagtcgagttcatcttctgtaaaagggggatggggaaacaatcaaaaacttttctcataaggctattattaagtacatattagcattactaaagtgtttgtaaaacaatgaatacatttgtataaattgataaagtttttaatttaatatatgtttatacatatggatattatgtattaaattatgttttaaatttaaatatatttgtctgccaacacatatgttattccatattaaaatatcttttcaattatttcatggaattctggaccaacagaggtgcaaacattaacctttagatttgactctgagcttcctagaagaccaaacaaaaagacactgtcatttatataatttttattatgataagctttccagtattgaatttattgccacttaatttctcaaacattaagttaatttcattatctgtaaggaaagcattatttctaccttctatacctagagagtttttctgaagatcctcttagataatgaaaatgaatatgctttctgtgttgatagaaaccctacaagcaaggtatatgggaagaagaagagaactagcgttttttttttttttttgcatgcctaatatatttaacaccttttgatattaacctcacagcagcctcactgactagataacttatcaataaaaatacatgactaaggttttataacaaattgtagtgctggaaaattcaacccaaacttacctccaaaacccagagagggcaaataattaaaatccagatgaatcacggagaattaatagaacaatgtaaacaaattcctaagttgaaatttgtataagcaaattgaaatttattcctcaaagaattgatataatttatgtaagctattttttaagatttagcataaattacatacacattaataaagcatataagcagagacatagcaaataaataagctctgcctaagaaaattttcattgacctgtgttttagcccaattagactgtgagataataatctagatatctgatacacatatttttatctaatcatgtatcataagctcttctaggaatagtatcagtatactatttatggtaattatttccatatacagaaattattgttctgtattaattattacatagtagtttaattgtaaggaaagttgttttagatacctggtaatttctgtacaatttatattttttcattagcaagggcttataatttaaactttctactttttgttaattttttttagtatatagtatataatatttatgttcttaacaagatatttctacaaatttatattgggtcctccaaaatcaatgcattttgagggtatgttacaacttgaatatgaagtatagcaagaaatatttttctctgtgtgtctaatgatccactgtgttgcctgtgtgagtataatgttattacaagcattttttgtaataacattagtacaaataaaaaaagtttctgtttttttttttatttttcctctaacaattttatatctgtaaggttttttaaacagattttggttcaggatatttacattaagaaataatattactgagactttgttcaaatagagctaattattgtccataatatagcataatttaaaataaatatgagcttttgagtaaaatttccctgagaaaaattccactatgtaatatatcaataaacttgggttaattatctaacttccctgaatcttagcatccttatctacaaaaattagaatgactgtatgttcattacagagttgttgggtaaattcaatcagataattcaacccaaattgtgaccaaatagtgtaatgcacatatagtgtaatatctgtatattacacactgtatgtctaaatggctagcatgttatgatacttaacaaatgttagtcttcctcctcatttttatgttaatttaattgatttgtggctgtcatcacagaatatagtatattctaaaataatgtttcttttacaataattttcaacatataagaagtaagtagttatccacagatagaattagcaacttggagtacatcagccatttccaatcataaatccatggatgggtactggcctctgacttcattttcactgtacaattagaaaaataaggataataaaatttattaagctaagttaatttcagttaattattgtggtctaattgtgttgtgattcagatgtcttccacaaaattattataacatagtgatgtttgagattttaaaaatacccttttgtagcaaaatcaagaagttagaactcctctgtcaattattcatctttatttctaaatttattttaaatatcaactctgccatgtactacttgtatgacttaggacaagttatttagcctctttatgatataattttatcatctatacaatggagatatcaataatgactacctcgtggattgttaagataaaattagataatacatgtaagactcacagagcagttctggcatataataagtattccataaagagctaaagctactgtcatcatcactagtctgtgaaatccaaaatgtgagaatcatccatttagataattcgtcttatgccaaaattactttaaaagtaggaaagcctatgtttacagatgttataatacctcaaagtcatagacagtctttgtagacacatgaagttgttattgaatgtgaaggtattttacaaaatatacctatttgctacaatagattgaatattgtcattgaatatcatctgtatttttatttgatgattttaaaaggcctatttttatattagactaggcttttgatgcttttgttaagtccaagaatacaattgatgcctatattatattttgcatgtaatttaattatcaaaatttttcttagtttttaaatatttcttaaactttttcatataccaaatgcataatgatgagagtctcaatagttctatttcaaataaaaataaataattgccaaatatggaatattatttctaatttttgttcacttttgagttaccatacatagagctctagaaacttctacaaactttatttatagaagtttaggaaaattagaacaatgtttataatttattaatttattaattatttatccaataattgaataatatttttaaaatagcttagcattttatttgaatatgaatagcatttgttctattttctcagaaggaagtgctatttttatctaaattctgaattattaatgccacactgtaagcaaaaagtacatccatgtttgaatggttgaagacgaagcattgcctttgagaaagaaaacagtacaataccgcaaatggttccttacagcaaaagactctgcttccttacatagttctagagaattctagcctcaccatttcttgagctacacctacttagaaaccttagtctgaccttttctaagtatgaaagatttgccctttgtccttatgggaaaatgagagggtttggtaagacctgctattaaccttcattaatctgcatttttagaacactaacaaaatcccattcctagaatgtaaaagctaagtggcagatactctatcttatttatcttttcatcactattacttagtatgatgcttgcaaggcacattaataggtgctcagttagcatttgtaaactgaatggatttcaagtccgctaaccaaaccagcacatatcaaatatgtgattacttttaaggagtcatgtttcaaatgggtcatttaattcatgtttcacactcttaggcttgatatccaagttatcttccatcattttgcattacatctattacaaaactgatagaaaccttgactgctacatttggagaagttagctaagcaccttattgagtaataatataaagttttgttaaaccactttatttaagggtgacttatattcaaaaaactctgcatatttaacgtatatacttgatgagtttggagataagtatacagccatggaactatcgacagaatctatgctataaacctattcattacctccagaaatttccttccaccttatttatttatttatttaggtgattgtggttttgatttggattttcctgatgattagcaattttgatttggattatgatgttttacataacaatggaaaatctcgtctcagcaaaatgttaagtatataatacattaactatacacattatgctataattatacatataattgtgttgtatagtaggtctctaggacttgttcatcttgcttaactgaaactttgtacactttgactcacacttctccacttccgtcttcccccatttcctggaaaatcaccattctactctcttgcttctatgagtttggccattttagatttatcatataagtggtgccatgtagcatttgcccttttgtgtctggcttattttgcttagcataatgtcctctgggtacacctgtgttgttgcaaatcgcaagattgccctcttttttgaggctaagtaatattccattgtatgtatataccacattttctttatccgttcaaatttaatggacatttaggttggacatggacatggttgttagtattgtaagcaatgctgaaataaacataggaatacagatacctctttgagatattaatttcattgcccctttggaagcaggattgctccatcaaatgatagttctatttttaatttttcccttttattgatatataataatttatatagttacagggtccatgggagtgtttgttgcaggcaaaaattatataatgttcaattcagggtaattggagtatcaatcatcttgaatgtttatcatttttagtgtattggtattctttcaagttctctcttgtacttatttcaaatatacattatattattgagaagtatagtcaccctagcctgctatcaaatattagattagaacttattttatctaactgtatgtttttaaccctaatcagtctctcttcattcactcccccgctccccactgcaacccttcccagagtctggtatctatggttctattctctatacccatgaaatcaagtcttttatcttctataagtgagaacatgcagtatttgtctttctgtgcctggcttgtttcacttaacataatgtcctccagttccatccatgttgctggaaatgacatgatttcattctttgttatagctgagtagcattccattgtgtatatatatattacatttcctttactcattcatccatcgatgagcatgtaggttgattctatagctttgctatcacgaacattgctggcagtaaccatgtgagtccaggtatccccttgatacactgatttcctttggatagatacccagtagtggaatggttggactataaggttggtatactttaagttttatgagaaacctctctactgtttccacagtggctgcactaatttacattcccaccaacaacatatgagttacctgttctctgcatcctcaccagaatctgttatttttggtctttttagtaatagccattctaacttgggtgagatggtatctgattgtggttttgatttggattttcctgatgattagtgacgttggggcatttttttatatatacccattggccatctttatgtcttcttttgagaaacaactattcgtgtccttttctcatgttttaatgaggttttttttgaaactgttgagttgtttgagttccttatatattctgtatattagtctcctgtcagttagtaatttgccaatattttccccattcagggggtggtctattcactctgctgatggtttcctttgctgtggagaaacttttaaatttagtattatccccccttttttatgattgtgcttttgagggctttgccataaaatctttgcctataccaatgtcctgaagatttttctctatgtttcttctagtagttttatagttttgggtcttaatttaagtcattaatgcatcttttgagtttacttttgtgtatgatgagagataggggtccgagtttcattcttctgcatacagttatctagctgtcccaataccatttattgaagagagtatgctttccctagtgtatgttcttggtagctttgttgaggatcagttggctgtaaatatttcaatttgtttctgggttctctactctgttctatgggtctatgtgtctgtttttataccaataccatgctgccttgtttaccataaccttataatatgttttgaagtcaagtactgtgatggctccaacttgtctgtttcttctacaatttttttgtgtggtttgttcttgattttctagctccttgagatgcatcattagattgttgagatgcattattagattgtttatttgaaatctttttggcttttttatgtaggcatttattgctaaaaacttgcctcttagcactgctttgtttttgtgtcccgcaaaacaaagtatattatgttttcatatgttgtgttttcattttcatttgcttaaagaaattttcctctaagaactgttcttatgttgctatgcccatattggcagcagtgggatgagcatgcttgatcttgggccccagaacagcatacactggcaccagtattagcaggatcagacagactgattcttaggcctctaggtggctgcttgcttggatgctggtagtggcagcagtggaccaggaaagtatgtatctctgggtcttgatcagtgtgcactggtgttgatagtggctgtagtcagagatcaccattcacagccccagacacagagctcgcaggctgtcctgctctctgcagcaacagttctgtagaggtggggaaggaccctgcctgtcacacactgtcctggacgctggggccacaccatcagtgggggcacagttgtcattcatagccccacacaggtagcctctgttcatgcacctcagcctccagtggcagcagcaatggctgtacttgtaacagtgtgcagacggaaagaaggcatcctactctgtacatatgaggcctagcagagaggtcattttgctggtgagaggggatctcactctctgcttgcaaggccaagtacagaatttgcactactgctggagacagagtcacttctcatagtcccagacagggaggtcttggcctctgaaaagcatgtgctttgtttcctttgtcccacggatggtgcgctgtaccatcctttccccaggaaatagtactccctgtggattacagcagcagtccccaacctttttggaaccagggaccagtttcatggaagacaatttttctacagatgggggtgggtattggggggagatactttcaggatgaaactgttccacctcagatcatcaggcattagttagattctcataaggagcacacaacctggatccctcaaaggcacagtttgcaatagggttctcgctcctgtgagaatctgatgcccctgctgatctgacaagaagtggggctcaggtggtaatgctcactcacccactgttcatctcttgctgtgtggcctggtttctaacaagccacggtcaggtaccagtctgtggcccagaggttggagacccctggaccagagtactggggactatgcagaatcttttgaaccaaccaacactgtgccactttagtggacactgggtggacactgagagatgtcagttggggctcatgggatgtagagatatgggggctatgattcccagggcaagatgcagtcccatggcaactgtgccctcacaagggtgcccagctgctgctgcttaggtcttggcagggacaggaatgagtgacaatgtgcaagtcctctttctggagcaatgtcctcatggaccctgcaaatcactccctatgctagcgtcagggtttctgtgggcgtaagaactctcccattgctcaaattgcagcagtccacagtagggatgtggactgctgaattacgctttacctacaataccaagccccttggggctcccaagccaaccttctctgagctggctgctgggtaccttttccttctctgcctcaggtgtttcctgtggcatctctgttagacatcagtattctttcctagatgttctattcaaggtatgattatctattcataattttggtgcttccttctggagaaggcaggtgcccaatgtctgtagttagccatcttgaaccagtgttcttatttttaaccttcaggaacttccatagtgttttccatcgtgcctgtaccaatttacattcccacaaacaatgtacaagggttccattttctccacttccttaccaacattgattatcttttgctttttgggtaataagcatcctaacaagtgtgaggtgatagctcattattttgatttgcatttccctgatgggtactaaagttgagcaccttttcatatacattttggccatttgtataccttctttgaaaaaatatctattcaggccaggcgtgatggctcacgcctgtaattccagcactttgggaggccaaggcaggtggatcacctgagttcaggaattggagaccagcctgaggaacatggcaaaactccgtctctacaaaaaatacaaaaattagctgagcatggtggtgcatgcctgcagtcccagctatttgggaggctgagttgagaggatggcttgagccctggaagcataagttgcagtgagctgagatcacgctactgcactccagcctgggtgacagaggcagaccctgtctaaaaatcaatcaatcaatcaatcaatcaatctattcagttcctttgctcatttttaaattttgggtttttttcttatttttcatttttaaattttattgtttttgctattaagttgtcgattttgtttatattttttggatattagtcatttaccaggtatatagtttgcaaatattttctccaaagctatgcctttttattttgctgattgtttccttcgctttgcagaagcttcttagtttggtgtaatcccacttgacagttttaggttttgttgccagtgctcttttgtgtcatatccaagaaatcattgacaaagccaaatataaaattcttaacttcaccaatgaggcagttttgacttcatgaggttctgaaactttttcctagagttgaatcaaataatacaatttaaattcctaattctttaacaaattaaagaaaaactatttcctccaactatagtaaggcaaaattttggctattaaacaactgaactctttttaataatgtgtgaagctaataggtgcctgatgggaccctattgctttgaggatctaattgcagacagaactatttattctttgattactagacttgtaaagcaggagttcaggaataatgattagcaaacaagattgtgcaggaatttgaagaataaattgacatatatcactgaaagcatacaaagtttcagtcaggagccatgaacccaaagcatatactgttctaggtacattacaggtgaaggtcgctgcattacatttaagagcctacgggcccttaaaagtttaacttgacaacagatgttagattgttcaagtactctaaaaataatcccttaatatatctttgtaatacaatagcacttgtattcctaaaataattttataaattttataaataataaaataatttttaaaaaatttgaaataaaatgaaatataatcctataagagattcattgaatgtttttaaaacattttatttatttatttagaatgcattttaacctactgaaatccaatataaataatatgtagaaaatagttataaaaaacaagttgtagttgtagaagacattaatgttttagaacaaagtatttcaagcttagtgttcaatgtatatgtgatgctaaggtcattatcatttggccacagatataacctatgagtaaaggagagtccttgttttttcataacctcttctgaatgcaacatccctctttataataggcaatattgcttccaagttgccatattcttaaaaaggcactgagtaagatcattgatcactgatatttgacatatttatgtactgaagagcacttttgtggaaaattcttccctcaattaattagatatgtttatatgtttatatgtaacagaataaaaagggaagatttcattcaaataagggcatttcaccagcccttttatgattatatatagtaatagttttttactatttaaatggctgaaaggtaaccacttttttaaaaatgttttttacatatatttctgttttaatatcctattatgggcagaaatgaaatgggacttaaattcaggttgttaccaatagtctaagattctaagtgcatcactatttcatgtacgcaaatattggctgagatttagcagaggtattgaaccagacaaatctatttatgcagtggctgttttacatttcttctatagagtattggcttcatgctttttgttagcttcagtaccttttgtccaaaccaaattactcacaagctgaaatgtaagacaattcaagattaaaaacgctatacaatcaggcatcacttaatgaaaagataccttctgagaaatgcctcattagacaagttcatcatagtatgaacatcacagagtttccttaaagaaacccagataggatagcctactacacaactaggctatacggtatggcctattgctctcgggctacaaacctgtgttgtatgttactgtaccgaatgctgtaaacaactgtaacacaataagtatttgtgtatctaaatataaaaattaagtagagcaaaaatgcaataatgcattatataagataaaaattgggcacacatatatagggtagctccattaaattctcatgggcgccctgcaatatatacagtccatcattgaccagaaacataattaaacagcacatggttatctttgacaggagggtgctaggcataaggggccagaagcctactggcttttaattctcctgtgaatggaaaatataatgtaagtcaaatgactatccatatagtatgaagtcataataccagatgactatccatatagtaacccatgtataatccctaaatcatagtacttgttccttatctatgcctctttctatttgccattttctgttcctaaatataactttcctatttttcacttctactcccacagtctacacagacgcacacacacacacacacacacacacacacacttcccactgtatatcagtgtataaaaactagacctgtctcatgattggttgtgtttacaaatatgttcatatttatagtaataaattactgaaaaatatgggcatatatgaattcaaaaaataaaatgtttaatatataaaagcatgttctgaataggtacaatttattatagaaagactttggatgctctaacattatggaactaatgtggataagttctttggaagtaaatactagacaaatatcttgattaaagtaaaattcaggtagcaatgttaaaacttttcataatgtaaacagctatgcaaagcatgacttttgaatttatatataaaatacattttcaaagacacagatactgctatattcattttgtgtatactgaatgttatttctgacattcttttagattcttgatagtaaataaatgatattttggagagtactaaagcttatttaaacatgatttgatgttcaatacaactaacaaaattgtagtggaacacaatgatattataaaaatgaagcttcatttgggaaagcatttccccaggtgggaataaggcattttctatgactagtctaaataaaagattcacttttccttgctttattttgggagggtggaggatggtagaaatgcaatttcaagtgaatgagtgcattctatttttcctgtttttttttttttacaaatgttataaaatcacacacacacacacacacatgcacacacgcacacacacacacacacacagagtatcttcatccatttttatgactccttagagataaaaggggttgagaaacatggtttggatttagttaatatttcctaaataccaaaggaatactgtttttcataaaataagggtgatactttcaaaactgtgctcagagaaaaatcaactgacacattttttaaaagaaaagaaaaaaaagaaaaattcaaaaccctttattagtttagaaaaggaccgttgtcaataccctgagttctaccaaattcaattttggctatttagtacaaatctgaaggagaatttttttatgctcatcagtcaggtccaaattcaaggagccattatcaaagttaggaatttaaacaacgctggaattcaataatgtgaaaatactactgattatttttataggagttttattctgaaaagtatgaagtatttataaataatatttcaacattcttttttttgaaagatggaaggtgaagttagtaacgggtaagttattatttgaatctcctagcattcagtccaagctttcaatactttaaacctaatatgatgtcattctaaaacccacgaggagtaaatgtgatttgtattgtattctacattcagtatgaagtgcacattcatgatgttgataaccttatatattagaactatatcatcatttcctataatataaacaaagaaaatactaaggatattaaattgaataaaaataaagaacatttacatcttgatgcttaggtaatgataaagattataaaataataagaaattcattgactattcccagccatttaatagtaacatcacaatagttgaagaatgaatgcattggtttgctaaggacaatgtccttcagctccatccatgttcctgaaaggatacaaccttattctatttttatggctgcatggtattccatggtgtatatgtacaacattttctttttttttttttgagatggagtcttgctctgtcgcccaggctggagtgcagtggcatgatcttggcttactgcaagctccacctcccaggttcacgccattctcctgcctcagcctcctgagtagctgggactacaggcgcctgctaccacacccggctaattttttgtatttttagtagagacggggtttcaccatgttagccaggatggtctcgatctcctgagctcgtgatccgcctgccttggcctcccaaagtgctgggattacagcgggggagacaccgcaccctgtcacaacattttctttatccagtctagcattgatgctcatttaggttgattccatgtctttgctattgtgaacagtgctgtgacaagcatacctgtgcatggtctttataatggaatgatttaattagctaggcatggtggcatgtgcctataatcccagctactcaggaggctgaggtagaaggattgcttgagcctgggtggcagagattgcagtgagccaagatcgtgccactgcactccagcctggttaacagagagataccctgtctcaaaaatcaaaacaaaacaaaataataggacaatttatgttcctttgggtatatgcccagtagtaggattgctagatcaaattatatttttgcttttgggtctttgaggaatctccatactgtcttccacaatggttgaactattttacactcccaccaacagtgtgtaagcattcctttttgtccacaaccttgctagcatctgttatttttttgactttctaataatagcctgtatcagtccattttcacactgctataaagaactacttgagactgggtaatttatgatgaaaagaggtttaattgactcacagttccacatggctgagaggcttcaggaaacttataatcatggcagaaggcaaaggggaagcaggtacagtcatcacatatcagagcgagagagagagagagagagagagagagagcgagcgagctaggggggaaatgccacactttaaaaccatcagatctcatgagaacacagtcactatcaggagaacagcaagggggaaaatccacccccatgatccaatcacctcccacctggcctcttccttgacatgtggggattacaatttgagataagatttcggtgggaacacaaagccaaactatatgatagccattctgactgttgtgagatggtgtctcatgatggttttgatttgcatttctctgatgatcagtgattttgagctttttttcatgtaattgttggccacatgtatgtcttttgaaaagtgttcatgtcctttgcccactttttagtgtgttttttccttgtaaatttgtttaaagaaccaatgtattctgccatgttaacagaatatcacagttggaatttatactttacaatacaagcatgttttgtatttttttgagataggatcttgctctgttgctcaggctggagtgattatggctcactgcagcctccaccttctgggctaaagcaattctggcacctcagcctcccgaatagctggcaatacagatacataccaccacacccagctaatttttgtattttttgtaaagacaagttttcaccatgttgcccaggctggtctgaaactcctgagctcaagtgatccacctgccttggcctcccaaagtgttaggattacaggcatgagccactgtacctggcctatttttttaatcaataaaaaatttctgtgtgttacatatataattctattataatttacttttattaatgtaaatgttatgacatgtatgatatgctattttggaatctcatttgagttagaggtctttatcttaatgcctctcttaatgctatgaaaacaaagcattttttataactaagaagacagagcctccttttgaccgtgtctttgctactatcctgtacttggctgtcctttctgttgtaaattaaaatagatgaaggctgtcgagccaagccaatgatggaggctaatttaatgcgatataattgatgaactctaaattgttccacttttcccttttgaaacacactaagtagagcttaaaatgccagatagagtattttgatttatgctctttgtcacattaatactgaaaaactcattgtagtgatagagaaatgggaattaaccctttatagatactttcatagtttctgtatatttggctgtacaacaatcagagaaatggacccagtttaaatatactaccagaataaccattaaataataataagaagaaatgtaatgaagaggctactaatttaatgctcatgaaactagttaaatgatatgaaaacaaacaactctaacagaaaaaaaatcaaattaagtccaagtaaaatactggatttatatccacatgatttttgtgaattttgctaaatctgatgcccttgaaccagaatacatggagaatttacaaataaggacaggggaaatcatgaaggcattttaagatgatgaattttcttaacatgtggcatactgatagagttcagttgaacataaagttgctacagttgttgctagtgtcaagaagaaatgtgggctgggcacggtggctcaagcctgtaatcccagcactttgggagtccgaggcaggcagatcacgaggtcaagagatccagaccatcctgaccaacatggtaaaaccccgtctctactaaaaatacaaaaattatctgggcatgatgtcgtgggcctgtagtcccagctactcgggaggctgaggcaggagaatcacttgaacctgcgaggcagaggttgcagtgagctgagatggtaccactgcattccagcctggcaacagagcgagactccatctcaaaaaaaaaaagaagaagaaatgtgagtagaccaaaaaaaagagcagctatccagaaatggccattactagcaatattcgtctcagtgctttttgtattaagttattaaattttagtaatatttaaaagttaacaaagtagccagataaactaaatacactaaaggaaatttcatatttatatacaccagcaacaaatagtaaatatgatttttttaatctatattagcaacaaaaatggctatttaggaataattttaacagatgctcaagattgttatgtagaaaattatgaagtcataaaattgtaaagttttataaagctttgttgagagggattaatgatgactcaaccaaatggagaggaatagctactttatggataaaaagatctagtaaagtcatcaattctactgaatctaagaagattcagtgtagtaaagttatcaaattgatctatagatttaataaaattcccattgcaacatgtttttataaaacatgaaagatagttctaaaatttacatggaaaagcaaagtatcaagaatatccaagacactcttgaccaggaagtataagattagatgacttgcctttcaagatactcagttttgttttgttttttaataaaactagagtaattaagaaatgtgattttttgcgtaaggataggcaattagatcaagagaacagaataaagagttcaacaacaaactcacatagaattaaaaacttgatatgtgtcactgcaaattattgggagtaaaatgaataaatgagagcttcacacagaaacataaatggatgttagaaacataagctgaagtgaaaaaagcaagatataaaggaccattcacagtcagagaacatttatttgtttgtttatttatttatttatcatttattattttaaataattgcagcttttattttagattcaaggatacatatgcaggtttcttacatgggtacattacgtgactgaggtttgggataccattgaccccgtcatcgaagtagtgagcatagtaccccatagttactttctcagccctttcctcctgctctctcatctctagtagcctcctctgtctgttgctgtcatcattatgtccatgagtgctcagtgtttaactcccacttttaaatgagaccatgtggtatttggttttctgttcctatgttaatttgcttaggataacggccttcagctacatccatgttgctgcaaaggacaagatttcattcatttttatggctatgtagaattccatggtgtatatgtaccacattttctttattcatctgtcattgatggacacttaagttgactcaatgtctttaccattgtgaattgtactggaataaaaatacaaatgtgtgtgccttttttggttaaatgatttatttcttttggatatatacccagtaatgggattgctgggtcaaattgtagttctgttttaagttctttgagaaatcttcaaactgctttccacagtggctgagctaatttacactcccagcaacactgtgtaagtgtttctttttctctgcagcctcaccagcatctactgttgtttgactttttaaaaatatgcattctggctggtgtgagatggtatctcattgtggttttgtggttttgatttccatttctctgatggtgagtgatatgaagcattttttcatatgtattttagccacttatatgtcttcttttgagaagtgtctgttcatgtcttttgcccactttttactggggttatttgacttttccttgttgaattgtttaaattccttgtagattctgcatattagacctttattggctgcatagcttgtgaatattttctcccatgctgtatgttgtctgttatactttgttgatagtttcaggctttaaaccaataacagtaaagaaggacaaagaagggcattatatattgataaagagttcaattcaacaaaaagacttaactattctaaatatatatgcactcaacgttggagcacccagaattataaaacaagtccttctagacctatgaaaatacacagacagctacacaataatagaggggaagtgcaacaccccactaacagcattagatagatcatcaaggcagaagactaacaaagaatttctgggcttaaattctatgcttgaccatttggacctaaaagatatctatagaaaactacacctgttaaccacagaatatacattcttctcatctgcacatgaaacatactctaagatcaaccccatgcttggtcataaaacaagtctcaataaatttttgaaattgaaaatataacaaccataccctcaatccacattggaataaaagtagaaatcaataccaataagatctctcaaaaccacacaattacatggaaatttaaaaacctgcccttgaattgacttttggataaacaacaaaattaaggcaggaatcaaaaaattattggaaataagtgaaaatatagatacaacataccaaaatttctgggatgcagcaaaagcagtattcagaggaagcttatagtgctaaacacctacctcaaaaaattagaaagatgtcaatttaattatctaacatcacagctagaggaactagaaaaacaaaaactaaccccaatgctaaagaagaaaagaaataactgaaatcagagcatagctgaataaagttgagacacaaaaatccatacaaagaatcaacaaaaccaaaagttggttatttggaagtataaataagattgatagactgctaggtagattagcaaacaaactgaagaagatccaaataaccaaaatcagaaatatcaaagatgatattacagccaatcctgcgaaaatataaaagttcttcagagaatattatgagcacttctgtgcacacaaattataaaatctagagaaaattgataaatttctagaaacacacaatttccccaagattgtatcaggaagaaatgaaatcctgaacagaccaatattgagttctaaaactgaatcagtagtaaaaacctaccaaccaaaaaaatccctgggccagattgattcacagctgaattctactagacatacaaaggagagctggtattcattctactgaaactattccaaaaaatacagcaggagagactcttccctaagcattctatgaagccagcatcaccctgataccaaaacctggaaaagacacaacaaaaaaagaaagttatgcaaaattcctcaacaaaatactagcaaattgaatccagcagcacgtcaaaaagttaattcaccatgattgagtagctacattcctggcatgtaaggttggttcaacatatgcaaataaataaatgtgattcaacacataaacagaatgaaaaacaaaaagtttatgatcatctcaatagacaccaaaaagttttcaataaaatccaacatcccttcatgataaaaatcctgaaaaaactagtcatcaaaggaatgtacctcaaaataataagagccatctttgacaaacccacagccaacataatactgaatgggcaaaagctggaagcttttcccttgataattggaataagacaaggatgctcactttcactattcctattcaacatagttctggaagtcctagtcagagcaatcaggcaaggaaaagaaaaggcatctaaatagtaaaagaataagtcaaattatctcgctttgctgatgatataattctatacttaggaaacactaatgactctatacttagaaaacactaaagactccaccaaaattctcctggaactaatcaacaacttcagcgaggttttaggatacaaaatcaatgtacacaaatcagcaggatttctatacaccagtaacattcaagctgagaaccaaaccaagaatacaatctcatttacaatagtcacacaaaaaataaaatacctaggaatccatctaaccaaggaggtgaaagatctctacaaggagaactacaaaacactgctgaaagaagtcatagatgactaatgaaaaacattctgtactcatggattggaagaatcaatatctactgcccaaaataatctacagattcaacactattcctatcaaactaccaaagtcatttttcacagaattagaaaaagctattgtagatttcctatggaaccaaaaagaaaaaaaagcccaaataggcaaggcaatactaagcaaaaagaacaaactatagacttcaaactatactacaagagtacagtaatcaaaacagatggtactggtacaaagacagacacatagaccagtggaacaagatagagatcgcagaagtaaagccacacacttatggccctgtggtctttgacagagtcaaaaaaaataagcaatgaataaatgactccctattcaataaatggtgctggcatagctggctaaccatatgcagaagaatgaaactggacccctacctttcaccatatacaaaaattaatgcaagatgaattaaagatttaaatgtaagacctcaaactataagaatcctagaagacaacataggaaacaccattctggacactgaccttgggaaagaatttataactaagtcttcaaaagcgattgcaacaaaaacaaaaattgacaagtcagatctaattaaactaaagagcttctgcacagcaaaagagaacattgttataaatatcaaaaagtaccaaaactacttatgacagtggttacctctggagtgataagcagggagataaaatagggaagtagcacataggttgatggatgatctagtaacattctggtttttaggttgagtggtgagttcatggatgttcattatcttatgtttttaatttaataaatgcatgtaacatgcattaacttaatatacaaacatatatgtagataatatataaacatataatcttttgtatatttaaaaatatatttaaaacaaacatattaaagaaatgaaagaaagaaaaccagaatgctctataaaaatagaatagtttgggggaattttctttccaaatatcaaaatttactgtggagctttctgaaggataaatcctttatggaactgaatagaaagtctagatttaggcctcttatcaaatatatggaaatttgatctacggcttgattttcaagtcagtgggaaaatgatagaatatttaattaatgatggtgggacaactgactgtggaaaaaaatgaaatagaatcccaatttgcacatgcacaaaaatgaatcccagatttattaaagacagtcagttttcacttaaaaggaagaaaatttttaaacttgaaaaagtataggagaatatttgagacaacagaaatgtattcttttacgattctggaggctataagtctaagatcaaaatatcagtagggttgtttccttctgagagctgtgtgtgcctcttcctagcttctggtgggttgctggcaatatttgacatttcttgacttgtaagtgcatccctttgatctttgccttcttcatatggcattctccctatgtctctgtctctctacattgaattgtctttataaggaaactggtcatcttgaattagggggcccaccccattttattgtgacatattaactaattacatctgcaatggccctatttccaaataaggccccactctgacatacgagggtttaggactttaacattacctttttggggagacatattttcaacccatgtaattgttatttttaaattgtatatatgagttatatgtactattttcaggatacatttaataattttatttttaggaaaaatattaagcagaataaatatgaacaataactattttgttccttaaactaaaatttttaagctaaaaaatgaaagctaacacacctaggttcgccatccctatagaatactttttgtgatatggggtatacggtcttgcctacctgtctagcttcattcccaccacattttcttatattctaaagaaagcaaaatattgactgttctatgctattttatagaaatattggtgtctttccatttcctattatagtctttctgcttattatatcctcatctttcttcttctatctctttctcctcctttcttcttccataaccctcttctctttctctttcttctcctagttaactccttcttctccttcacgtttcatgtggaagccttcccggccccactctccagtcactctcatatgagacagccctcctcttttgcttccatggctgcatgtggatttctctttcattgcttatttgatttatgtgtactgaagacagagaatctcaatgcctaggatgatccccgaaatctgatctgtactcagtaaatgttaattgaaccaaaccaatgatgttaaatatctcatttatgtttcatctatacctatgaccttggccatcagattgcctgcttcctctggatcctgagaactaaaaatactgtctgtatgcttctatttttcaagcacaagtacacattatagtgattcaaatactaatggatattttagcattacatctagaaattttcttcacttcccagaaaataagattggttaaaataatagaggtattgattttaaaaagcagggaatatgctgtatatttattacttctcagaccagtgatatttcttcatttttttatacttagtgaattttatctcaagcctcattttactctaaatctgttctctactacaggatagctccttgctttggttaatatttaactttttaaaatatatcacattaccttggtgagtaaaatatgcatgtactataagattaccatcactataaaattatgcaggtactataagattattgtcttttactgtaagattactgcactatagattactgtaagatcactgtcataataaaatatgcatgtcctataagattactgtctcccaaagatttcagatttgtagagtaaaatgctttcactattcttttcctttgaattaccaggtcagaccacagggattatgcagaaagtagtttatttttgtgcgttgtgtttggtttctttctaaacaatctaaacaactttttctaggcttaaaaaattagtttgtgtgctaatgcattacttattgacagacatggtcatatttagtatctaattagtggacagagttaattttttcacacttcttacattttcttatatcatcccagcctcaggccgtcttccacttagctgtcatattagttccctgtggctagtacaacacaattactgtaaactcaatgacttaaaacaagttattcccttgcagttctgaagatcagaagtctgaaattagtcctaccctgctgaaatcaaggtctctgtagccaagcccctgctagaggctgtaggggagaatccatgttcttgccttttttagtttctaaaactgcatttcttgcattccttggctcctggcccttgtcaaaaccagtactatcacatcttactttagtggtcacattagcttgacttcttctctagttaaatctccctatacttctgttataagagcactatgattacagttagggcccctcaggatgatccaggaaaaaatccccatcttaagacttaatttaatcacatctgcaaagtctcttttgccatataaggaaacttgcacagattctagagattaggacctggagattttttgggggtgggcattattcagcccaccacagctactatctgaccaaatcacatagtgcacttttatctgccacagctttaatttcccccatgaatttatttaataccaatgttgtcttccatttttacacccatttcaaaactctgaaatagaaataggttaagtgcagacatccgacttgtatcacactgaccaccagatggcaaactttgtcattatatttttaggcctaatctgaattaatttgacagcctgagtagttaaatatgccaatttaaagtcatgtatagtgccatgcagtttagatcaactgaagttttatcacactagatcattttttatgagaacagctacacataatcagatattaatttgagctactttaatggcttctgaaaaagattacttccttatctagctaacgtcaacaactaagcatgcttctatttcacagaaaattcttccaatgcagtctctcttagtttttgagtaatttcttacaaattctaaatttaattgatatgattaattattaatctcaattttaattacttatatacaggatttttcctagaacttgtttcattaatgaattcaactcaggcaggtactaatccgtgtcgcttttatcctgtagtatcacataatatataataaaaataatggctacaaataaggcagctttctaaaatagcaaaaattattattgttctactgttttccaaaatcattgcactcttatcgtatcagtctaaacaattcagagacatcaaaataacagctaatattcttcttctttccctcttacagaaacttttatagaaaagttcagaaaatgtatatttaagtaagttaaaattcatgttctaaagataacactttttgtatttcccaggcataaagatataggtatagatgtggatatcaatgatatggaaatataattgggatgattcgtacagtgagttttttcttcttttgaacctcattcacaatatcatattaagtttattggccctcccctattccatctccccgtatcccccaagccaaagtaaacattattccaaatcttatttgtattttaaatatatgtgtgattatatatgtatgtgcatttacctatacatatatatacacattaatttattctgatttttcatataaagttatattcttaacattttccaatgttattaagattccttgaaaaatttttaatggtcatatgatattttacctttttggtattccagtttaaccaaatagaccaaattgtctccaatttttcactatgataaatgacactttcatagaaacttataaatcttgcttatatctctcattatgtatttcattaatatagaatcttagcggtggaattactaggtcagaggatatgtggacttttgatgtttttgatatctgttggcaaatagctttccagaagggccaaaccagtggcattctcttaatactcttgccaaagtgcttcattaatttaatttttgccaattaggtaaaaatattccttgatgtgctcctgtttactaatttatgactccctttcaagttatttaaattatatataatgaaatttatataaaataatcattatccagcttactgcactaatattgaaaaggaacataaacatttgagatgatgaatataatttataaaggtggaagggattacagaatggaattcagagtcctctttatcttttagagtagggttctctggcttcttacttcacatagatcagtgttgtcaatactgtaatagaaagaaaatgagaataaaagtaacactattaactagaattttttgtgtctttagcttttagtaagtcccataattgctttgtaacttcttttccctgagaaaattggagcctgaactctcagggttcttatgaagatacaatcactttaaaaagtgtgatcttcctaaggggaattattgttttaacaaaatctatatacgttgataattttaaaatatttgaaaatttataaactctttcttcctttttaatactgtttgttagaaatggctaagatctttgtataggaaggggacataatttcaagtgacattatatttgctcttcctcttttgtttgcactagagaaagccttgccatatctgatacatcattgtctgaaggtatgcttgcgtcatttccaattaaatgttttaagtcagcagtatacagtaaattatcataaatgttattgtaagttcaagctgaaatgttagcaagaaaattgctaaaggatatcatttaagctcttactggttctgtgtatttgctaatgtctgtggtgtatattactttgacgagcctacagtgacttctaacttgaattaaaatacagttttggttaattttgttaaggtcaagacaagatttaaattagaatataatttgcttagttatctcactttttttgaagcaagtaagcaatgaattgggaaaataaattatgattgtttacttaagattctcagaaagggaacacacatgcttcgttgacaacagtggcatcagtagactgaataataatttatgctatattcattacttttttattcctgatggaaagaagagctggttaaaaggtagcagagaccagttaaatgttcaggtctattttaataatatttatacaaattcattgactttataataatttgcatatttatttgaattttgacctacttggccttagaattgtcagtgaatataaggcagtttctgaagaaagcccgaaacactcactacaatgctagaattcaatcggtatttgttggcatgtcacacattcagataccttgcatgtctaattattatatactgaaatatatgtaatgaagagcaaatatagtgaacaaaatatatattgggtgagcaaagtttatgtcaagtaaatgattgacacaaatgtagttctgcttttttggaattctggtatcacaaacttattccaatatatctgaagagtaaaatcttgttcctgtggttactgtaactaaaagggaatggaaaaggcagggcaggaaaagatttatgggattcagagatgagaaaatgtgagagatttgaagaaaaagaaggtagaaaagaagagcaatgtatagactttgacaaatgagaagaaataatgaacaggaatttatagtataaagaagaaggataaaagggtacatttagtctcacaaaactagaattgtacaataaaagaattattctaacccaaattatttaattatcacaatgttgttattcaaatcctgcacatcctttgtctcacagacatctgaaggcctttagtaccagtccagtccatgacaatgtcttttcctaaaatctcatcacttgtttatgctacttacttgacaactgattgaacacttgtaattctgagttgttctgtgattaaaatctgctattataagttaacattttatgctttaaatctcaattttctaagtagaatacaaatctggaagacaagcactctgtcctatttcttgatagtttctgtagttttagcaaagcatcttgcattgtagagggatctcaattctttaatgactgagtgtaatatatagcatttttcaccaaaaagagtcatttatcctatagtaaaaaaaaaacaataaaataacactgaaagcatgcagagacttgggtgaaatttagaagctttggaacatgtatttcatcagtaagttatttactttgtttatgtgatagtcctgacatggaaaatcagtgtaagccaagatagtattgacagaaagagcataataaatagaaaaggggtacatgaatcagattatttacattttgaagatggtggctgcaatgagtactgcacttgaattaatccaaaagatctcccttgagctgaaagtgtgtgtagtcataattgcgtgacctgtgacacattgtctttgtcccactggcaggttacaaaattggcactgaatcaagatagagtaattataggaaagtagaaactgtctggatattccactgaaagctgaagatgtgatccattcttgatttgctttgctaatagctttaactttgagaagacagagagaatagtaagataaacaaccaacaggtgggggatgtaggagtcctgggagagagaaaattatcatgccatttgagagtatataatataaggaaaagagaatagagaagtgaagcatttacatacccccaggttttggcaaaatgtattccaaaatgtttacaggaaagctattttgattctgtggcaagagagctaaaataaaataccctaataaatcattcattcatttattcagtttaagtaatggtattagaaagggtaaagctataagtgagttaagccttcaaaatgaactttttttctttttttgttaggataacctgactgatacagcaaggttatgctgcagatatgatatatcttaactttgtaatggcatttatgaatatctggtgttcttttgaagttgacagaaaaatggacactgggtaatagcatagctattgttggtggtttctgagaggggccaataattagcactcttttctttctctgggttctaaacaaataggaactaacagttaatttgaaaatactggtcaatatatcatttttattattgataaaagtcatgctgcaggacataactttgggtccataaaccaaattattttgctaattctgaactcaagaattaggcagattttgtcacctgccatggataatacattaaggtatgctgcctcctgtgggtaggcttcccagataagaagttatgagagacaggatccaaaccaaactcacatcatctgcaggcagacttgcttctaaaaggaagagaggcagattcatctgtagaattaatcacttcacctccttggaacacaatgagtaagagcaggagagaagctaggagagtatctatggaaaattcctcctcatcaaaattaggaatggcaaaagcttttcccctctaactttgccttgcatctgttctcttaggccactgagtttaaccataaagcctgtggtcaactatgtgagggaggagatcagcagtttatttgggcaggaggcgaattctaatgtcagctgctttgggcattatcctgagatccatggtggtcagttttgattctacactgagaagattctgaaatgggttggaacaggacatatatcaaatcagcttcaatgacactctgtatctgaagctggaaatttaccgccaacttatttcttatcttaaattatatataactctatggccatattaaataactctaatactagaatgtgtaaagatacatcagtaataaaattccaaaaacatagaaatgccctaattaaataaaatctcctcactttatcaacttcccaaggaacaatcattaaagtttaaaagattatatttcttggcaagttaaaaccataagtaaagtctaaaattattttgcctttgtgagttaaaaattcttcaaataaattccaaaaccattcttcagtatttcttattaaaatattaaacattcttcaatattagtctcagccataagcactcaccattcacaggaagagttgggattgtctgtttctcaccagaatgcctagagctccttcagtgtcaacactgctatattagttcaatgccaagccttctgtgggcctgattttaaataactcaaattattaataatacatggaaaattttcagagcactggccacacagtgaccaaatttagaaagcagaccaattcctaccctttaaatgagttatctcaggcaaaatgatatgcctaaacctaattcttagtgtggccaaacaccataccagagactcagtggtatctaaggaaagaagggtagattgtaaaccctgattttaatcttgacatgatactattggtctataaaagttgtccagaattcttgagctatgggtttaaatcccagtgggagaaatccctaagcaaatggttgattttggtattatgcatacttacctcttagagaaacattgctgccttcttgcaagatttagaaatttgtggctgggcggagtggctcatgcctgtaatcctagcactttgggaggccaaggcaggtggatcacttgaggtcaggagttcgagaccagcctggccaacatggtgcaaacactgtctctactaaaagtacacagattagccaggcgtggtgatgtgcgcctgtaatcccagctactcaggaggctgaggcacgatgatcgcttgaacccaggagacggaggttgcagtgagccaagattgtgccacttaactccaggctgggcgacagagtaagacaatgtttcaaaaaaaaaaaagaaaaaaaaattagaaatttttaatcatatcaacccagtcccgagcacatcttattcatgccttctcctccaagacagtatttttaaaactttagtttccatttatcccaaccctaaattgagagtgactgtgtttggtgaatagcacccatgcttttgtgactaactagaggcatttcaatcttattttgctgtggctgttgccactgtatgtctctatgactttacttcccaggaagtatttgtctctcctctgtcattagccaattcagagacaatctaagaccacatggtagagagtgaccttgagcttgtgttcaaactaaacgattgtaagtttcatccataggtcctatcttagtcctaaattaatttttaaattcaacaaatatttattgaacatcttctatctaccagatactttctagatgctgagattaacatacataaaaatccaagtactatcagtagagacaaactttaaataaacaagcaaaatatgtagcatattagatgatagagaataatgcggagaaaaacaaaacaaggaagagggaaagtggctgtgtgtgtgtgtgtgtgtgtgtttgtgtgtgtgtctgtgtgaagatgattgacattttaattgaggtggtcagggaagaagtagaaaatgaaattttaggtaaaggaactagtgttggctacttaagcctaacactaaccatttaaagctcatgcacattctgtttatatatatacacacacacacacacatatacacagtaaccatttaaaactcattcaggttctgttttctatctatctatctatctatctatctatcatctatctatctatctatctatctatctatctatctatctatctatagtctctccataagagattgaatgagccaagaaagctgtctagtcatcagttgctgaaggactggctaagacagaaatacacagatacgtttctcagttgccccaagtttgggactcactcctcatatatgtgtacaaagtacaaaaattaaaattcaagttccgtaaatttagaacttgacttctttgtagtttactatgtttggtaacagcaaatattctgctcaataatttccaaagcctttttttccatgtgattaagtcattgcctcagcaaagcttagaaatagttgcatttgcatagtaaatggcatattaaggccttggccctagttgaagcccagtgatcttcatttttgttttctggattgccccatcacttgttctatccttaaggaaatggagtggcttatttgatttctaaatttaagtgaaataaacagcatcagttataaagatgatgttgtaggaccttttccttagttcagctaaaaatggggtccttatcacatgaccatgaaaggttaggctcacagatacattgaagggtgggaaaaattgaatttattgggtgaaaagaaaaaaaaaaactcagcaaagtgagagaatttcctgttaacaggcccccatctcaccaattgactcccaggtaccaccctagaacaggagaggccacgttcctcccgctgcaaacagcacgaactttctgaggctccacccagtgtgcattcctcccattgcacaggcctgtcaaaggttctgccaggcggcccattttacttggctatctcaatgatattatgttctttatcttcactttttactttttaacttgttcagaatcccaagcggatgagaagggtctacttaataatagaaaccttatcagagaccccaacagttcaatagattcattattgattgctatgtaagtgtccatttctagagaaagggtaatgaagcatgtatttcttttctctgatccacttaaaattttcatcaaccaagaaataaatggcctgattatcaaatttagatatttatgggaaaattcatggaaaggaaatatattagaataaagagaatttgtagattaagtgtgaaatatatagaatatatttggtgaaagttaaaatgcttttggtaaagggaagaaaatcatagggttagatatgtcttcttagcaggaatatatcataagccaatacattcaagaaaatttaccagttggttggtgaagcagacaaaacacaggaagacgctgcaaagtttttgggagcatcattagaccaagagaggttgaatgagccaagaaatctgtctggtcatcagctgcagaggggctgactaagtaagaaatacacagatgcctttctcagttgccccaagtttggaacccactccttataaaaatatatacaaagtacagaaattagaattcaataacatatggtccaaaaagttgtattccagagcaagggctaaggagggtcaagttttgggtaagttttgcagtggacaaaggatggtttcacaaagtttgaaaataagggaaaacatgcctagtctgctagctagggaacttcttgggtatcatatacctcttgccacccagagtagacataataaactgaatgtttctaaatccatataccttatctgtcctatcttttgatatacgacatggagggaaccctggaatatgaaaaagcaatactcattcttgtggtggcttttatgatttttattgaattactagcaagtatggcaactcactatcttgattctctttgcccccaaagggcattgacctgttcaggggatggaatcggggtcaacatgaaagaaaacatgcagagagacaactaacacattggaagtttaaaggttcaaagagaattctgcactcaataaaaaaacaggttaaaaataatcacaacagtaaaacatgaaaaatgtataataaataccaatgtgaagttccgaatttagtttcaaaaatttactcatagacatgctaagtaaagaagacttgtcttgatcaaagttcacgtcaaggtattcaagggtcctagatgaccatctgtcaggaaagtcacagcacttctgagcctgctttaataggaacattggacttagtaacctccagtattccttccaaatctgggaatgagttactccaatgagcctgtgactttctcaccttctgatttttgtggtttaacacattgttccaagtacataagaaagccgatttatatcagtcatgagtaatctatgctacatcaaactgcccttcacatttaaaaaattcaaacaattgaaattcattttttttaaaaaacatcatgtctcctttcacaaaatcttaaaagcaagtcagattgcctattcatttatcacaccagttagtcaatgattattataggtatcttccaatggagacttaaaaaaattatatttagcagatgtcttcacaaaggagcattttactggagaaccattttttagcattttgcaatattgaactgaaaatgactccattagctaatagcaaaataatcccattttcctcaaaggaaaaaaatatctttaatatatgtattgattaaaaggaaaatgccagtgtgtgggtcatttacgtatccaggaagatttaagaacctcttgaagaacttcaaaattatagtcataaactacttaaatgttcaacacgaactccttatacactaaatgaaaaagctaactggattatgttgcatttagaattttttaacctagaagctagcatgttgtggctcagaattgaatcattagctttgcattaattcccagaatcagggagaaaagaaatctttcttcagtaaattacttcttggggttgggggaactactgagagattgatctgagctttgttgcagcaagagcctcaagtcataaattattggcacacaagcagaagtcagtgtgtcatttctattgtagtcagatgcttttatatttccactcgtcaaggttgacttgatcatattgtacacctcctggatgtccgagacatagcattcatttgtccctctctttgagagcaggacaggtatttctttcacaacttaaacctctaagtttaagaaatatactccatagtatgactgtgggggtattctatgtgtgaaaaattttttcgagtgcagatttcaaaatttgaaattaaccaggttctcatttttgctctttgaggagtaatatgtattaaaatccattctgaggatctagcttttaaatgaccttttcagtactcatccttttgctcattttgatttgctcagataaattacaaccacctggccttttgtattaaaaaaggttacatacaaaattgaccttttgatacttattgagggaactaggttcattgtatttgagattaactgctgttgctgttttctgaatgatgtcttaaataactttacttgaggatggtaaagcctatttcttgtgccattttgttccaggctaattctaacaccataggaatggactgtctgagatatacaaagaaaattatgttttagaaaataatgaatctaatttattcagctcctgtgtgcctaatgatttacagatgtgatttcaatgtatcttaatcttgataaacccaatattatactttggccagtctgcccttcaccatattgcttattaagattctagcttctttctgtctgtttcttgaatattttaagctcaggcttgcctcaaaacttggtgcttgattttcccgctgcctgaaatgttctttttttttttttttttttttgagatggagtctcgctctgtcacctgggctagagtgcagtggtgcaatctcagcacactgcaatctccacatcccgggttaaagcgattgtcctccctcagcctcctgagtagctgggactacaggcgtgtgccactacgcccagctaatttttgtatttttagtagagacaggatttcaccatgtcagttggccagtatggtctccatctcttgacctcgtgatccacccacctcagcctcccaaagtgctgggattacaggcgtgagccacctcacccggcctgaaatgttcttttctagcttcctttgttccattcacctaatattctatttgccaccctacattttctggcttctgtgtaattaggttggactgtgtgactatttctgataatgagttgtatcacttgtgggctgaagcactgaaaagtccgtacacgattcactagtcctttttctgccatgattcttcgggaagttttgggttgagatggaaagtgacaagattgaaacaatctatatggctgatttcccaaatgggaagttacctagaccagaggattttgtgtgtgcaaaaaataaacttttctgtgttcaactactgagcttttgggaatgtgtgcctattctgattaactattcagggtttcagggcaaatgtcatttctcttctgtaaccattctatctaaagcactttccctctgcactgtatctttcctctgagcattttgtttcccatagcaatttttttccataatacttttatgtatttgtttatgtaagtcaacgtcgaacaaacaagacttctgtgtgctgttaattatgattcttaagtgcccagagtatttttaaagttgtcaataagcattcatttttcaacattttgttttaatgtcaacaagtacaaaaagcaagataaaatactatcttgcaaaggtccattgaatttcctgttggtcaccagaaaagatagcctgtatcaagccatagcacagtttttaagactctcctagataaatccattttgcattatttcttttatcctgaaatgagatcatctttggcaaagtctttataggtaatgctatctgtatcaacacagaaaagatttagagtccgtattttcattttaaaatttcccgaagagtcaccttcaaaaattctgcaatatttttgcatatatggaggtgttcgtccactaacgaatagctttgttgcttttaactccaggctacataagtacttcctccaatagcagactatactatctgccagctgcctgcttccagttttctggcacatggttcagaagagtctctggtattttttttgctggcatggagaagcttgctgaatagaatcaaaagagtcaccccatacatcagttactagaaaaagggcatgcagtaggagctcagtaaaaattcattcaattaattattacaggcaaatttattcaccatggaaatcttgatatgagcaaactatcacatttttctacaaataggcttttattttttaaaaacgatgaaagaaaaaaacaaaatttttcctagaattttagtctaagctattcaggatcatcctttggaatttgaagtaaagaacttcataatttgcttccagtccttaatggagtttcttgacaaggcattaagactttacagaaaaatattttcttattgctaatgcatgaagacatgtgccacatgaagtacagaacttcatttctcattaaggaacaaaatgagatatgtgatcaagtagaagataaaaacaagtatacacaggtatatcatctgcataatcaaagttttgcatggaatattcatcttcagtgttatgaagacttaagtgattttcttttgaaaaagtgttcacaagttggaattctttgttaatgagaagtcagcaagcacacagttgacaaaaaccagggattgtctatgctggatcatgttagtgtttcacttagactaaaaagaaatgatgaaattctaatcctttcctaatttacttcaaaatactcagtgttagcaaacattagaaatttctggaatggatgtgataattagatagggatattattttacttttctttgtttgctccatactgcaaattagcatgatcatccccccgccaccaaaaaatgattttaccaaggtctatccagagatacaaagcttaactgatttgattaacaactttgtgatatgcttcaagacacagcttttgtgttgagaaaaattcaaattttggtaaaattctatccacccccccacacactctttttttttttttttttgagatggagtcttgcttttttgccccaggctggagtgcagtggtggtcttggctcactgtatcctctgcctctcagattcaagccattctcctacttcaacctcctgagtagctgggattacaggtgtgcgccaccaggcctggatatattttttgtattttttagtagagacagagtttcgtcatgttggctaggctggccttgaacgcctgacctcaggtgatctgcccgccttggcctcccaaagtgctgggattataggtgtgagccactgcgtctggcccctatcccttttaaattaaatttattttcatgaagacttacaaatggacagatgtcaggcaacccttccattttcttgacttcaaaatttaattacaaagaatcgcccctgtaagaagtactgttttgtctcccatgatgtttaagtaggaatggatagcatggatatgtaaagataaggaagatttgctaatgaagattattcattttctctgacatttcctaaattaacctaaacaatgacagcccatgcttaaaaggaccatacttgtaaaagtaaggtatattttatttaattcctgtcagtagaaaccttttaaaaataccttattacaaggaaatgatggtgatgctatcaggtcatgtagtttgtaccaccctgctcttgttaatattgacaatttccagagttccatgagactgattttacattgaagttatgatctacaatcagtatgtaaggctgatatctttaagaaacaagatcattcagtatagagtataggtggcattgcatatacaccaaagtttacagaaaaaaacaaagtttgagaaccagtgagctacatgaagaaaacaaataaatgaaatgtttccaattaaatgtctgagctttgaactaattctgccttgaagatcattttcaaattcttatctagcaaataggaatgtgtcagtaattctaaagtagttttgctggcttttagaatttgttcccttttgttttaagcattaatatgagttgattgatttatttcttgaaataacttaaggaagtagagttacattttggttcaggatgaggggctgttagcttctgaagacagcagtaagttaatgattgaatccactgaaattgcagggaaataattaaagtatcatctattagtgccaggttcatagacttttccagtcctcatctatttgccctttagaggtctgtgatctgcagtttgaggaatctctggcctagaggttctgtgaggttcctgccaggtctaaaaatctgtggagattgtgtcttggtcatatgaattatataatcagtgttatccaggtgacaacaagaccctcatttgttgacataatttaatccgttattttgaccttttggtttaattttactttgagtgataacgtatttactttgatacgcatagtcatgcttatactttctacatacattgacatgcatatgtactatatatgcattggtatatacatatatataagcttattgtattagtcccttttcacactactgataaagacatacttgagactgggaagaaaaagaggtttaattggacttacaattccatatggctggggaggcctcagaatcatggtggggggccaaagcacttcttacatggcagcgttaagagaaaatgaagaagaatcagaagcagaaacccctggtaaacccatcagttctcatgagacttattcactatcatgagaataacacgggaaagaccagcccccatgattcagttcctcccactcggtccctcccacaacacgagagatttctgggagatacaattcaagttgagatttgggtggggacacagtcaaaccatatcacttatatatgctattaacattttagaggatattttgaaatctatattttaatcaaagatccagaaacattttccgtttttcctttgtctttcctctgtctggtagcagacctgatgacagtgaaaggtaggtttaggttttggcacattactgcccaaatagcaaccccaaataactgaacaacctacctggaaaatctgctgtggctatttgacaatattttgcttttgaataatgaagaaaaaataactaatcttaaggttttatggaatctcgcattattaaaggccttctggacagtcactcaagtttactttgcaagttaatacaaatattgcaaaaataccatttgacaaagaaatttcaaaaatcattggaaatgaatattatcagccaactcagtgaatacttgtcagtgttagacaggtagaattttttttttatttttaagttaacacattatgtcaaacacagcatattgccggcaggtcaaagattataaaagcctagaaaaaaaaataacaactgtaacctgaataaagatgtttttccaaaccactcccataatgactaacatcactatctaggaaaattaacctcacactggaagactgaaagcagaagatttccaatatttttctgaacaagaatttgaaccttgtgccttgaagatttagttatataaaatggtagaaaaccatgctttcctaatttaatgatactaaaagttcttgccacttctcttctttacaccatcctaacatcaaaagaacaaaaaatgattttttacttgtattactgtatgctaagtatgtttgtgttaataacagaaagcctcttatttcatgaattgttgcataatcttttcttcagaggctttattttagtttgtagctcaaaactaatgacaaaatcattttgagtgctctttttatacctttccaaattgttttgaatataattgctgttagaaatattaatgcattgtgatgactttatggcagtttttttctatgatctttgcagtattgccataagctagatgatgaggaacaatatgaaatctgatattgatttgcaagacaggtccacaaaacatccccattctaaaaaaataaatgtctacctactttcaaggagaagacataaattctagaacatcaaaggacatataagagttttaaaagtttatgcataattagagtcagttttatcataacttgcctttacccacatttggatgaaacagattcttatactatattttattcactcattcattgttcattcataaaacactgttgactatcaactaagtattgtggggaatgaaaaacaaaaataggcttttgccttaaagaagatcccagaaaagcatggagacataaagagatggtgccatattaatatcacaaataattcatagaagaggtgatcatttcaaagttgaggtgaggtagaaggacatttgaaggtggaggagagaatagatagggaacctatgcaaaagagtcatgtagtaggaggtatgaagacaattgcaggcagagttagtcactgctttgttttttatgtatgtgtatttttaaggagtattatcctaaagtcattcaaagagttgtatgccttgtggtgtttggaaaggtagctagtatcaagtttggggaatgataccgtatttgaagtaatagtattaagttgaagaattatctgtattcatatttgatagaatcactgactctacctggttgtcaaatttaagcgtagatattcttttcttttgtatttatttatttatttatttatttatttttgagacggagtttcgctcttgttacccaggctggagtgcaatgacgcaatctcagctcactgcaacctccacctcccgggttcaagtgattctcgtgtctcagcctcctgagtagctgggattacaggcatgtgccaccatgcctggctaatttatttttatttttattttttagcagagacaggatttcaccatgttggtcaggctggtcttgaactcctgacctcaggtgatccacctgcctcggcctcccaaagtgcttacaggcgtgagccgctgagcctggcctgattttcatatcatttttaattccatggtttgttttataagagattttgaatagcaaaacagttattatgtacaacaaataagatagtaacatctctttaatttttaaattttcttcacaacaatgtttatggcagtatgattataatctattgtattatgatcaatttgttcttttggctttattgttctgctgaataattggcaatagcagattagttataaaacagacacatctgctatatggcttcttatgggtatacaaaatgttaagcttcattttatataaaacacaatcctggaaaatctattaattttcaaattttcttaagaaaatacgatacagtttttcctaattttcaggatgagtttttatcattcttagtcacaaatggtggaaggcagttccaaatctaaattcattttaccacaataatgacagtttccaactgtctcataaatttgcaaaacatttgttaaaagggagactagtagagcaaaatgtgtcactgttgctgaagaaaatgggcctgtggtaattagtgtgccgtcttctgagacaaaaatagtgcttgaaatttaacattataattgtaccaattagcagttattgagtgctcacaatgtgccagcctctgtgtggaacagcccaagtgtgttatctctttagtctcaaccttatgacttaaagatactattgctattcccattttatggagagaaagaatgagtgaaaggtctcagtaattagattatgatccaattgctggtaagttcaacagctgggatttaaaacaggtcctctaaggtataggcgtagtgtaggtactgttattatttatagatgaaaaaaattgaggcttagagaggtctaaataatttggttaagctcaaacagctaaaaagtggagaaactggtatttaaaagtaggacaattgttaagaattaggggaggagggcagaaattagttgcaaagataatcacgatttactccatttgattattttagggctatcacactaaagcaagagtgctacgagggaaaatgatgttctcttcctaaatttcacagtaagaacatttgcattagtctcccaaaggcagaaactcagctgtttcagcaaggactctctaactagtcttctactaggtgacacagaataaatttatttgtctaattctttatttgtaactttactgacacactatattgtgccctaattatttccattttaccagatttgctttacaaactatagtagtaaagtcctgggcaagaagaatatttttcttgttctttacataaagtaatttagtaggcattcagttcttaaaaactgatagaaacacaaagctcaggaaacaaactagaatttttaaatatactttcgcattctacaaatttaaaaattgaacaaaagtatcagtcactgatttttttatgagtttttgggagtcacaataatagattacagtccatggaactctattttttgtcaacgattgtgagtttggaatatttgttgatttatattacaatatgtgatattgagtattcattaattctattttgtagaccttatacttttagatataaggaaaaggcaagatgaggaaaaagaagctgttcattttgtctagcaatcacttgtcatatgagatgccgtttatatgctgaggagaacaaatacaaatggagataattgataatacaaatcttagaaaattgtgttcaaacacaaagtggaatttacaattttctcaagactttttgtacatgagtataggaagggtagattgtatatttgtgtgtgttgtctgggcatgttggtgtgtgtgtttttaccaaagacgaagaacctggtgtcttctgcatttactatccttagcatttgagataacattatgtttgcattttgcatagacatactattcagatcaatttcccattcctattgagagaggcataaaccagattctatttgccaggagctgtatttttaataatataattttgaagttatattaaagtgaataatttgataattcagatcacattcactttttactttgaatatgtatttttaaaatgaatttgttacttcaaaaaaatgtgatctacaaacttaaattgttacttattaacagttgcattatttctatcccatattgtcatgtgaatgttctctttttaataataaaaaccaggtattaaaacaaacattttaaataataaactgtcatggcagtttattatttaaacttctgcttaaataaataaacttgtgtttaaataatttggcctgtgttcctttatcatctacaagggaattttatgaatcttcactcacaggactacatccatttacattcaaagactagtagttaacattttaagtaaatgacagagaatctttaaaaatatctgtgaataatgaagccattcattgtgttcaaggattttgcctttcttcaataatacaattttcttctcattttaaagagtatttaattgcatcacacgtcctattttaatatttaataataattttattagctgtatagaatgagaagggcaagaattgcaatatctagtgctggtcatcaatttttttatcatgacttaatgaatatcataattacaaggagaggcaaaaagataaattagcttagtagttggttgggacttgctagtttattggttttagcctgggcacagcccagaatagtcacaaagagaaagaaacaagtatctgggggtgctgtagaagtccttgcacacaatttctgcaccttactaatcatgcctcattttgaatgataaacagaggctttgaacaaaattataaacactgccaataataattccttctggttccatagcagttcacaggggattctgatgacttacaaaacttagtcttggcaggtatatgttcctttaatttctattaatgcattttgacaacttttcattatcttttcttaaatatttttactgttttttttttttctttttcagctaagacaaaaatctgagttattttgagtaggaaaatttggcatagccatcactgtaataacactttttactcaagtagcacctctcacccgaggctttcagagtgcttttgagtacattgtattaggcctgcaggatggaggtcaggggaaaagttatttgtaggcaccgtacatttaaagcttctgtggacatacagccaaggccacggggagaaagtaattttcatctttagtattctagatatggatatctgtataaaatgattcctaacttttcaatgccatttgttaaaagagggaaccagatattgttgaatttcatgtgcttttaaacctattttaagataaatcatttttaaccccctccagcaactgcttcgagaacgacagcagatggccagccgtccctttgcttctgttgatgtagctctggaagtgggagctgaacaaacagagtttctgcgagggccattagaggtaggaacagcggtgctgaaagaggaccactgtgctttgcatatttattatattgcttctctaatctacatctgcttatgaagccaaacagagtctgattatctacagttgacaagattcagctacatatgttatgccattttcaaggcacatagttttaatagtatgacatgagctgtaaccaaagccactggagaatctattagcctaggcaggagtgacagactgctcacctggcagcctttctctgacagaggagctgagggaatttaagatataggtatgatcgaagaaacaaagcgcctatatttagtctttggagtactctgtgcaccaagttaacaattcacatctatctttattaacaaagtttacttagaaaaggtacgagtggagatgagttgcattttaattacatagcttcatttttgaatgttgaaaagtgaatgtttctcacatataaaatgaatatttttatttgtggttaattgctgtattattacattcctttattgcaaaggcagaaatagagtatgatgaaacagaaatcattatatgcaactaaatatggtattagaatccaaaagtaatacatgaagtggtttctgaaaataataatccctaaagatgcaaaattcggccgggcgcggtggctcacacctgcaatcccagcactttgggaggccaaggtgggcagatcacgaggtcaggagatcgcgaccatcctggctaacatggtgaaaccccgtctctactaaaaaaaaaaaaaaaagaaaaaaaaaaaaaaaaattagccgggcgtggtggcaggcacctgtggtcccagctgctcaggagactgaggcagaagaatggcgtgaacccgggaggcggagcttgcagtgagccgagatcctgccactgcactccagcctgggcgacagacagagtgggactccgcctcaaaaaaaaaaaaaaaaaaaaaaaaaggatgcaaaattcacaaattatgattaatgactattcaaagcattatgatgcatactaatttaattgtatgtttattacttttatttacttttatatgtggtaagatatatttaagtagaaaggttaagaaactctagaattgaaacattttattctcttttttaaaaatgtctttatttgactaattttatgttgccattttcagattttactttttgtcaaggaaaataaagaatggaaaaatagaatcattcaaaaacctaggtatacatataatagattctgtctgtagcatttttgttttttctgaaaaaataagacaaaatcacaactcatggatgctactcaaagggtcagtttttagaggaaatgaaatattgggtgcatgtttccctatgatttttaagacattttgtgtacttgattttttactactctagatcacaggttaccatggaagcttagaacatcaggaaatttgtgtgtatatcttctatttgttggggaaaaaataacaaaaaagaatgattaaatgaaagttacagcaagtgctctaatttcattttggttccttgtttcaaataacttttataaaaaactttcacacacagaaaacttagactatttttggactattataaattctttttatccccatctgtttaaaacattcttaaatactgctaaaaatcgagtaacaagagaaaaaaaatgtaagtaatgcacacatagactaaagaagaaaagaaataaagaactagaaaattcacaaactcaaggaacaaatatgacacagacatatgtcaccatagtttgtcagttgcacgttaatagtgttcaataatgtattgttaggtacccatgtgttcataatcatcatatcttcatgttctattttttccaaatgttggttctttctttatcattgtgaatttttaaccttaaattgtattttgtagagttaaaaaatgtctagccctactttcttttagtccatattttctgatattccttatttcatttgcaatttcgctatatccttttgttttacaactatactttctggaaaaaactgttagcttttttattttttcatttactctgttttttattgatgttaacactgacattaactactgttctaccaaggcttatttcagctaccccattttgtgtgtgtgtgtgtgtgtgtgtgtgtgtgtgtgtgtgtgttgttactagccttgcttctttttgtttttttttcccagcttctgtccataaactgattttcatctactaaacagaatattgcatattctatttttatgttgcttatagctaccctttccttatcaagattcatagtgatttttccctagctatgctttaatcttattaaaacatattcctccattgcccatctcaaataaaattaatactttagcatgctctcaacttccctctgtttctccttccatatgttaataccacctggaatttttatcaaaacgttatggatgtacttctttctttattatggcctatgtaaagaacaatgaactttatttgttctcctttacttttgatatctagttgtttgctcatgcatttcttttatttttcactaagattacctctctaaaagatttttttcaaagagaaactttgggtccagcatggtggctcactcctgtaatcccagcactttgggaggccgaggtgggtagatcatttgaggttaggagttcaagacctgtctggccaatatggtgaaacgccatctctactgaaaatacaaaaattagctgggcatggtggtgcacgcctgtaatcccagttactctggaatatgaggcaggagaattgcttgaacccaggagatggaagttgcagtgagccaagattgcaccactgcactccagcctgggcaacagagtaggactcctcaaaaaaaaaaaaaaaaaaaaaaaaaaaaagagagagagagagaaactttgtatggcattatctttgagaacctaaatgcctaccaatatgtttttctcacatgtacaaaacagtttaattgaatatgaaattttaggttcaaagttctcttctccacagctttaaccattgtctcaagtctgatgtcaatttgattttttgtcctttgtaaatgatctccattttctttttggaatttttcagtattttctcctttctcagtgttcatacatttttctccaatgtgtccatatgtgtgtgtatgtgtatatatacatatgtttcttatttcttcccaagtaataaaagatacacgtaaatttacgtatttgctagatcggcagttgaggcgggaagaagtgaatgtttagggttatctagccatctgcttttatagctatgggatttcttccctgagatgagccctataattaccctgtcatcagtgtattagtcagggttctatagagggacagaactaataggagatatatagttgtgtatatgtatatattctatatatataggagtttattaagtattaccttacatgattacaaggtcccacaataggccatctgcaggctgaggagcaaggagagccagtccaagtcccaaaactgaagaacttggagtccagtgttcgagggcaggaagcatccagcatgggagaaagatggactaggccagtctagtcttttcgtgtttttttctgcctgctttatattctagtctcgctggcagatgattggatggtgcccacccagaataagggtgggcctgcctttcccagcccactgactcaaatgttaatcttctttggcacatcgtcgcagacacacccaggatccatacattgcatccttcaatgcaatcaagttgacactcagtattaaccgtcacaatcagtctccagccttaggctggcacttgactggttctgctgctttcctgccccacagcaggtgggatcggtaccaatctatccaggacaatgtggactgtggcccatattatctccatgtttaaaatcaggagagggaacaaatgactcattctgatttgctattttgttgtctgtggggtcatttttgcaagtacttggtataacataaagcattatattaattgttgcaattcttactatttttatttttcactcagttctcttaataactagcatgcctctatttcttttgtatgactttttgcagaaaaataattacatgtaaattctcgtttaggaaaggcctttatatttggggatcaagatctagttattaatgtatggtatttttatggaaatagctttattgaaatatagaacatataccaatagttattatatttatatttaatatatataatgttctaatatttaatatatataatgcactgatttttggtatatatacagttatgtaaccaccaccaaagtcaattttggatcctgtcatcaccccgaaagaaaccctatgcctttcagcagtctccctaccccacatttttcttcagcccctgcccccccaccccacacccatctcctagccctgggcaacgattaatctaccatctttacagattttactgttttggacatttcatacaaataaaactatatacagtgtgatcttttgtgattagcttctttcgcttagcataatgtctttaaagttgatacgtgttgtagcgcctgttagtgcttcattcatttctattgtcaaatgatattccattgtatggatgtggcacagtttgtttgtacattaattagttgatggttatttgagttgttttcaccttttggatactatgaatgatgccactgtgaacatttgtgtaaaaaaaattgtataaacatgtttacatttttttgggtatatgcctaagggtggaattgctggattatatcgtaactttttaccgcttgttgaaaagtactttctttctccattgaatagtctagggacccttgttgaaaatcaatttaccataaccatgaggatttatttctggaatctcaatattattctaccaatctatttatctattcttatgacagtaccacactatcttgatgactctacctttgtagcaagttttggaatctaaaagtgtgagtcatccaactttgttctttttaaagactgttttaaagattgaatttcaacttcctaggtcttgggaatgatcaaaatgtttaaattgaggttaaaacattatttttcaaaattcctttacatacactatctcaatctcatttgagtcttaagtcaatcctataaaataagcagaacatatttcatcttttttttctatttactattgaggaaactgaggctctgagagcttcagacctatgctgaagatcacaaattcagtcaccagtagagcaagaaccagggttcaaatctcatattggcctaagggtttctttcccacattgctttttatatatgctgattttcgttcaaattgagaagacatcttagaccttaatatatctatagaattttttttgtaaggaatagagttacttaaagttcatgtagtatactttgattccaggtgctcaaatagtcatagataattgtggatcttaaggaagaactttcacttggaaagttataggctgtcttagtatatcagagaattccagcagttatccattgtaatctaaattgctataaagaaatcaaagtgacttactaaactgcaataaactcagcacacaagctttcttttatttttatattagaagtttcttataaaaataacttttgtagttttgttatgctaataaagtaacagttctgtagaaacaaagtaatttaagattgtttatttggtaattatagtcaagtaggctaattaataattttaaagacagttgtttacagcatgattaatttttaccagactaattatttcattagtattctctgtatatattttaactactttataccagaattttcattttacaaatttgtaatgttttgattctctccacctataaagaaaattatagctttcgagtactataaagtggagttttcaaaaagacactggacatgtaagaagcatacggtaacctagaaaaaattaatttcgaatctactttctatttggtagctctaacagtgctaattttgacatcacattgaagttcattctctgtttattgggacagttcagcctcgtatcttatgtaagaaacctcgctcccaaggtgaaaaacgcattgttcaagtctaaggcagtcaaagtgaagcagctgtcctattaagagcattgatggcctcattcctggaccacattaagcccagtcctctgctcttgggcacagccagtggtccccctggttcctcattcctgtcctgccatatccatggacagtagttccagtgactggcctaagcagcttatttaattttccccaggtttccttttttcttatagctgatttgtgatatttgatatttttaattattatcatttactgttaatattctgattatgtaaagaatacatcctcattatagataaatattaatgtaaaagatataatacaaattaaaatatttcattatcccattacccataaatattcagtgccagaacttttatttctttccaataacattttcattttgcatatttgtatttttacaaaattgagagcatattttatagtgattttgcattctgtttttctcagtattagaataagaacatttttcacatctaagtttgattcaaaaatacattttaattattttgtggtatatcatcatttatttgcctattctgttttcaattagcattattctaatttcacactattataaataagactgcatttcatttttgtatataactcgatcttactttatgaaaaaaaacctactgaatcaaaagttattaagttttaggatcttgaggtatattgcttatttactttctagaaatgtcgctgttcacactatctttagcaaagtatgagaatttctattttcatgcatccttgtcaaaaatgattgttggtgtttttgcaactgttaatttgatacaataaatgttaccttctttcttttaatcaaatttttattgttagtaaaattgaatatttttgtattgtctgtaaccatttgtatttttcctagatgttcatttgttgatcattattctctaatccttttctattttaatagcatttattgatagtcatctgattatatgagaaatattgtattaattctagaaaacttagaaatgatagctcattcgatatctttcttcatctttctattggaacattccttgcctttttacttctagatcaaatatattaagcatttgtaaattacctgctataaatgttttctctctttggatattgattttaaatgctatattttctctacttttaattaatcagcttattgtgtcttttggtaatatttttcagaccctacctttgctttattttcatcctgaatttcctattatttttccatctttaaaaaatattcccttttatcctcaattgatttgcatgttataaaatttatttattttagtggttactcttaacattttaacaggcatagtttaagtcaaaaattaatgaacatttttccctcttcccaaacaatataaatcttgcttccaatttaagaacaatttaaatcttgcttccaattttctttgtttttgttacctttgttaagttctatgagttttgtcattccttgaattaaacattattgttgttgtattatatgatcaatatgtgtttaaatttacttacatattgtgtattttcttggctcacagttgttcttcgccttcagagcttccttttaaaatgtttctactttcctgctctgtctttaagtaatgcctttagcatatgtcttttgataataaactctcttacgtctttctatttccctctccagtttcagtatcctcttattgtttacaatctaagaaatgtatttaaaatatactttatcaagcattctagttatctttcagtgggagggtcacactcacacattgtgttcacgtgaaaattgttctgacactggcttctgatttccgttgttgctgtagtaggtcccttcatatccccagggaatatgttccaagagtccccgtggatgcctgaaatatgggatagtaccaaaccgagatatacatacctatgataaagtgtaatttgtaaattaggcacaataagagattaacagccgtaactgataataaaatagaacaatattaataacttgccagcatcactactcttgcactttggggccattattaaataaaataagggtacttgaacacaagtactatgatactacaaagctgatgtgataaccaagacagctactaagtgatgaatgggcaagtaatttatacagtgtagatgcaggctgaatatgctagacagagataattcgcatcttgttccaagtcagaattatgtgcaatttaatctttttcttctggaatttttccatttaatattttcagaccacagttgactacagataactgaaaccatggaaagtgaacccatgcataagggaagactactgtactaaaaactttccttcagtatcattgtcactcctttatagagaatctagcttttctctccaaaatccctgtgtttggtgttcagcagttttatcacaatttaacaaagtatacctttatttgtttttaacctacttggcatattttgtgcttcctatatttgaggatccaagtctttggttatttctaagttattgagtcattatcccatttgtattttctttattccccttctaagactctgattagatgcgtgttaaacctctttccatcttcacaatctcttagtctttctgttttgttttctatctccttctcaatgctgtttcttttggcttattccgaacattgttccaattcactaactattttaagtgtataaaatctgtttttgacctgctttctactatgtccatttggattactatcaacacatatttttattactttctaaagttatattttattatttatttattaaagttctatttggttctttttttaaatctgacagtttttgaaagtctcttcttccttactgttttcattacttcatttttcattccgaataaaattatttttacgttgtatctgatcatttcaatatctgaaatccttggaaatctaaatctgttgattatttctgctggccctcaatcattatgactgatttccttgtgtatttggtgatctttatgagctcttatatgatcttagtttgtggtttgctagtgacccaaagaatgctttcctgcatagaggattgcttttgccaaaaaccaagggcctctctttattctgtagtcacttcttccagggtctctggaatagtgcaggaatctcaaactcagttttcctttttatttatttattatttttttgagacggcgtcttgctctgtcgcccaggctggagtgcagtggcatgatctcagctcactacaacctctgcctcgcaggttcaggtgattctcctgcctcagcctcccgagtagctgggactacaggtgtgtgcctccatgcctggctaatttttgtattttcaaactcagttttcttaccgtgtgagttgctcatattaacttttaccctcagggccactctgctgtcatatttgcttgctgctcattgcaccctctccagttttatctggttgccttggagcagttttatctggttgccttggagcattcccttactggctgcattctcagcaatgcattaaaaggtatacttcattgggtaggcacggtggctcatgcttgtaatcacagcactttgggaggcctaggcaggaggattccttaagcttaggaggtcaaaatccacctgagcaacatggcaaaaccctgtctctacaaaacatcccccccccccaaaaaaaaaggctgggcatggtggcatgcatctatggttcagctactcaggagtctgaggtgggagaagtgcatgagcccgggagttcgaggctgcagtgagccatgatcatacactgcactccagcctggttgaacagagcaagaccctgtctaaaaaaaaaaaaagaaaagtatacttcattaagcatttggttattttgaagtgggaaggccctacttacactatctgtagttgtctcctctggcaactctattttactgaacacaggttctctttggattgccattcctcctcctggccttggctcgatattttcattgtcaccaatttaagactcaggctttggcaagttgaaagggatgggaagggaggtccccttcacttgttaatgtggtagtagcatagaaacagtcaagccatccatttcctacagaccttttggtactcccccagtttcagagagaatgaggactcagacccccaattctgcttctttctaagcctcttggggaccagagagtccaggtatagtcttttaggaactgtattgacttttctcttggtgtttacagttctctctagaccaagcctctgtaaaattcttacactgggtcttgatgctggttcctatgcacttggccagtccaaatgggagaaagtaaggcatgagttccctccaccagagtttctataggacccaatccctaattgcacatagttgcctataggccccatgagccatttgccttaagagagggagatgattttcagttggtagtagacagaaggaaattgtaaggaaattgccaaattcttcataaaaaatgatttagaagataatgattttttttttttttttttttttttttttttgagatggagtcctgctctgtcgcccaggctggagtgcactggcacgatctcggctcactgcaacctctgcctcccagattcaggcaattctcctgcctcagccccagtctgtagctggggttatagacacccactacaatgcccagctaatttttatatgtttagtagagacagggtttgaccatgttggccaggctggtcttgaactcccgacctcaggtaatccacctgcctcgacctcccaaagtgctgggattacaggcatgagctgccatgcccagccatgattttttattttaagaaaattatttacaataaataagagatttttataggcacacctttggttcttgaagtgaggaaagatctagtttcccagctgcattttggaattttcttcatctttatgttaaaattataaaaagacctttcttcaccaaaaccatttagcaggcaatgttttggaaaaaatgttttggaaatgtcagatttgtagtattaacataaacatcgtgagtttcatgattgattgaagcatgaaataagaattaagtaatggtgcttcttcaatattaacatgatataaatagaactattaaaaaggtatgaatataatgtattactgaaattattgaaatctacatggttttaagttaatataatctgaactttaagcatgataaaagtcatttgtttacagtttaaataaataatttgataaatgccctaggttaactgtcctaataaagtaaattactgctatcatctttcattcagaattcactgagtcaaaagctaaatatatatatttataattattgtatacatccaaaattaaaattttacaaatgaaatttttcattgcactattgaaatattatttttatcttatcttaaatcatttaagatgaatataagctatgatggagaaaaatgtaaagatgaaaatgaacaacagcaacaacaaaaaactggtttctcttcactgtgtctgacataataaatagaaacatttggatgtacaaaaggcttatagtcctgatcaaccttattcatactggctgccattcaagagaataatgtattatttaagcatatggtcacatcacagctgaatcaatctagcataaactatttttatacagcatccttgcaagtaagaaatggctatgtaaagtaagactataatatcctttattggaaagttataaatacagtttaacaatgcttgggaacagtgttatagctttggataaacaagactgaattgccaacactgtcctccacccttcacctactgtcagataaaagaggtaacatattgaatccaccaaaaataactgtgctcaacagaatgggcagattgtatctcctgcacccaagaacattccacaatctatgaaacacagtagggtaaatttgagtattgtcaaaccctttgaatactcattcctatgtatgttaaaatgattgtgtttaaaacattaacacaaaagtagtattaacatcctaattaatacaactttctcagtaacagcaatcagctagtcatatttttggctcctgtttctaaccttttagattgtcgtgaagcattcattttatgtctggtagtatgcagtagttatttcctagtttttgtttaaatattttattaggctgttattgcctatgacagttacttttacactaaatttatgattttgcttaatatattttttgcttatgtttcatataaaatcagttactaatttaacttgtatatccttttttctgttacacgcagtaggagataatctcatcaggtttatatcctcaatggaatagctgactgtaagaatccttaaaatgctgttaaatcaaatagaatcttatgaagtgaaataccagatattcaaaatgtaaagctagatattttatgtgtagaatctaagaaaccaataatgttatactttagataaacattttcatgtgttcccatattttacttccttagaaaataaaatagcaactaggtcaaaatttagagtattaaatatgcaaatttacctcaaatcttaatatagattttttttcatcaaaggtcatagttcttacatatttcataccagagaccttttcttatattcacacttgataattttgtttatattattatatgtctttttaaatttgctttatagagaaaggctctggatttaccattaatgacatataaaagtggggcagaaagttgggtgcagcagcacacacctatagtcccagctacttgtgaggctgaggtgggaggatcatatgaggccagaagttccaggccaggctgagcaatatcaagatcctatctatctatctatctattttgtttttttgagacggagtcttgctctgtcccaggctggagtgcagtggcacaatcttggctcactgcaacctccacctcccgggttcatgcaattcttctgcctccgcctcttgagtagctgggaatacaggcacacaccaccatgccttgctaatttttgtatttttagtagagatggtgattcaccatgttggccaggctggcctcaaactcctaacctcaagtgatctacctgccttagcctcccagagtgctgggattacaggtgtgagccaccacacccggccaatcctatctctttaaacacacacacacacacacacacacacacacacaaacacacacacaatgttatggaatagactatcaagtatgtaaagtttaagtgcaattttttatgaaggagtttttatttcttgatttttttactcatcccagcacattttggaaaataaaagtaataacagctcagttttatttttccatattttaaactggaaattctaccttaaaaacaaactctatatactatgaacaattgtctccacaaatattgacctatatgcaaagcaatacaggaggtagatatggaaaatatgttatctttacctttcagaaacttacagactaacaagagagatatgtgcgtgtaaaaatacctctaataaaaatatgttattaatgccaaaaggacaataagcatgaagaagaggaaaaaggaatacaatactcaatgtattgctgaatgtttcaggaaaggttgtggtcatttatcttgggctttaaaggtacctaaaatgtcagtaggcagagataggaataggtgaggatggagacaggtaagaagcatgccaagttgagagagcaaggtgagcgagggacggagacagaaaacagggtggtatgtgagtgaggcagtgagaaggccacattcacccaatgaggaagcagctgtgagagttaaggtagcaaatataggagcatatcatggaagacaatttaaacaagatgccgaggatcacacagaaggtttttgagaagagttttatgattaattttagaaagattacactggcagcattttctagcatcaactggattgaagaataattgaggtagagaaacaatttggaagggcaggcgctgaactagtgattgtcaaaatgttaaggtgcaaatattactgaaaactttgacaatgtagaatatatagaatgtaagtaactgaatatagggatagtctgggtcaaaaagagggaggggtcagaaggttgggtcttcttcatatgtacttgaactcatgggagtgagaaaagagaattgaaggtagaatctaggaaaattgctacaaagaaacaaagattcaaatgacaggctgagaaagagtacagaattaagaagattgaagagttttagaactattagaattaagaataagactgcatgccaagaaggatggtgtggtaaaatatgtcatccatttcaaagcagtcaatgaagataagcactaggagaaaagatggaatttggtaattatgcagtcattggtggcttttgaggaagtaatttctattaaatggcagaagccagaccgcaagagatgtgtgaagatgagaaagtggatgcaacaaggatagatgacccattttgaaactgacaatattgaaaggaaggaaggacatgagatagtaatttaagaaattggcagtttcaagagaaagtttttttggggaagaaatattcaagggaaaaaatgtatagtaggataaaggggaggtgaaagcagagaaaggatcaagaagtcaagtagaagtattaattttagaaagatgaaaaaggataataaaattatgggtaaagatgaaagtacattttgagcctttctatttgataggagtttaccttcgatgatcttataatttttcacgataattgagaagtaaggtcacctgcagagagtgaacttgatgtacaaggttgaggcttaagaatagtaagagatgtagaacatttgtttcaaaggctatgatggttaagacaaaaactgagttatccatctcctttcactctattcttcattttctatctgtcattgagctctgcctgttctacagcctaagtatatcttaaatgaatctctttatcatcactactgcccctgtttcaagccttcatgatttttttcctgctctgttacattatcttccttactggtttccctgccttcactcttccaggcagttttccacattgctactaaagtaatctttctagcatgcaaatcttctcatatcaccttgctcagaattccccaatggcttctctattagtccattctcacactgctaataaagacataccccagactgggtaatttacaaaggaaagaggtttaattgactcacagttcagcatggctggggaggcttcaggaaagttacaatgaaggaggaaggggaagcaaatatgtccttctccacatggcagcaggaaggagaagtgccgagtaaaaggggaaaagtcccttataaagccatcacatctcatgagaactcactcactatcatgagaacagcatagaggtaaccactccatgattcagttgcctcccaccaggtgcttcccaggacaccacacatggggattacgggaactacaattcaagatgagatttgggtggggagacagacaaaccatattagcttcctatctcttatagtaaaaaaaaaaaaaaaaatacaactcttctatataatgtactatataccctacatggatctgatactaccattcctatccagccatttcttgtcatttcaccccaataagctgactccacacaacatccctgcccttgcctctgactctgtctctgttgttctcttgtcctagaggaaattgcctaaagtggtagtttaactaattcttaaagttcgaaacaaaagaaagaaataataaagaaaaaatgaatgagaaacattatcttaaggtgataaaaaggattgctgagcaacagtgaagcattgaggatatagaaattatgtaggagcacagtccctattcttgtgaataacagttcaagtagaagtgaaagggaaaactgatgtttaagatcttaaaaaatatttgagttacaaagtaattaggactgcctgattttgctttatttattgattattctcaattagatagatctgtgttttaattgctcaattatgcaactttcttattgtattttaatgcattaaaatactatgtgtattttattaaaattgtatgtgtattaaaatacacatacagtaactcagacttaaaaaaataacaaaaagaactttgtttagaaaaaatatagattttaagtgaacaggaaaaatctttttgtaaccacattgaaagaagttgttcagccagtatattgtacacatctacacatatgtttttattctaggagtaaatataaatgaatatgtattcaacatgaataaatgtgagtaaatattgagtattaatgaacttacataaattttttgcttataacttcctgttagaagaagcattctttcaaaacttttaaaaatgtattgcatatgtggcctcttaaatgtctttgaaagatacatcataacatctatgtgtttggaggaattttagaaatttttagaaactacgttcacaaaatagaatgattatgcctatataaattaaatttcaagcagttccaaataacattttattaaaagtacattaaattttgatgacctcattcattaagcaaaataatgtacagtgctctatactagacattccagatagcacaaaagtgcttatgacataattgatactctagaatatcttagaatctgctgttaaggatgacattaattatatcaccccttgaatcatctctttcttcttctgctactgcttcttctttcattctctttcagtctagttctcttactacacactatttctcatgtgttacaataacatgcaaatgatgataaacccaaagcaccataggatctcagaatacttttaattcatctaagtaagtttaatgttagtataattagtaataaagatatttcattatatttacattaatatataaaccctctttttgccataatatttgattaactatatacctctaatcagcctcccactgtattgaatttaatgtgagtgtatgaatatgtaaatgcacgcataatacatatacacagttttcatccagcactgaacgacaatgtgattgtcacaataattattttcctacatattcttgaattgtgagggcaatatagttataacatcagttgttaatttttaaataatgttagctatttctctaagaaaagtaatatatcttaattgtaaaattttgtaaaatgcagaaaaatatattatacaaataagaagcctcattcatactccatcactgtttgttctacaagtgtgtgcagtcatacagtgaccacaccaatcaagatatacaatgtgctcatcaccatggaaagcaaagcccatcactctgccccaagacccttagaaccacttatttgtgcctttatagttttgcctttcccagaacatcatgaaaatggaactttttttttttgtgaccgagtctcactctgttgccaggctggagtgcagtggcaagatcttggctcactgcaacctccgcctcccggggaaccatattttatgcagacttctgtgtcttgtttctttcacttagcacaatactttcaatgagctccaaccatgccattacgtatcagtagtttattctattactaagtttattccattgtatatccaccacagtttatttatccagtcaccagatagtagacatttgtatttttcaggacctggagctactgtaaataaagctatcattaatgtttgcatacaggtctttctaataaaatatgtttttatttctctcaggtaaaaagctatcagtaggatttctgggccatatggtaaaagtatgtttaactttagcaattttccaaagtgtatatgccatttcgtatttctccccacaacacatgagagtttcagttgcttcacaacctcaccagaactaggtattgttgagattttgtattttgttttgttattctaatgactgtgtgatggtatcttgttgtattagattggtgcagatgtaatggcaaaaactgcaattacttttgcaccaacccaaaatttggttttgaagagacgtaaattaatttccaacattggtggggtctggctacccatttataggtatgcatatcttcaaacgttagttttcccatagctatatatgcatagatatcaactgaggaatattctgtaatgaaatactaggggtggggaatatgtaatatgtgcttaaaaaacaagaatccaaaaattgaattttggaaaatatcttcataaaataaacagttgtatatttccagttcttatgaggccttcttagtgaaataactccattatataagaaaagaaatattaatatcaaaggttaatttttaacttttataagaaaaaactgagtgtacatagaaatagagagataagtcatatcactcaacttcgagaactgctgactcatggccaatcttgtttcatctttatgctctctcaccccgaacttcagcattgattattttgaagcaaatcccaggcatcaaagattaacttttaattgaatctcagagtttttgatttatcatattagtattgaaaataattatcttaaaatgtttaaatttttaaacttttagtattaatccctaaggttttagtagtctcttgatttgacccatttacatgtggagtatttactaggtatgatattccaggcatttattcaataagcaataggaaaatcattatacctgaatgggaataaaagcttattaagtgagattgttttactttattagcatactttgtatatagtttctttgatagcattttatagacattaaattatatgaactgtaggttttgcataatggaagttgccacttaacaatattggcccctattttttattcactataatatatttttgagttacacattgactataatcctaggagtactttcttaattcttatattataatactgatctaatttttctcactgggaagctcagctgaagtgcataacaggttttaattaagaataaaaggaggaaagaaaacaaaacttcacatcattaggaattctgatttctgctgctctaacaaaaaagaccacaagcaatatgagattcatcaaatgtgagaaatgataactaaccatgttaggggtcacctataacaaactacaataattgagaaagtaaccttgacgcatttcagttgaagtgtgagtatctgtagtttattatattccagacagtatacattaccaaagatgtagggccaaattaactttaatgttgcactcttcacaagacattccatagctagcaataacattaagataacgctgttaaagtaagaatttcaattataaggcagatgagattgtgaaaacatgacagctttaatgagcaatagtagttgggattactttgataaggaatatagttatcatagatagaaaagaaacaaaatacagcctgcagccttttcttattgtgtcatgtcaccctctattgataacagctttgggttccaattcatttctattcattctcccaacctgtgctagaatgatgatcctttatcttacatatactgttagaacaccttccaattctgcattccttcattcttccaaatagctgatagcatgttatcttacttgctctcatcacatcttggttaagaaagaaaggcaatcaagatattggccccatcttgcaggtgggaaaactggatcgataactcagtggtaatactgggaatagattcagattacttgaaagatcaccaaatgcttattcaggaggctgactttaaccaaggaatatgtaatgaatagaacccaaatacagtatcattctttgtggttgtatgagacatgctcttgtttttgaatttagagtggtagagagagacatgatcttgtttttcactctggaatgacagccttcttttcctctgatcttattgttcccaccagtgatcttcactattccaactagtgagaggtgtgttattccatctggactgctacaacaaaaataccataaacttctgttgacttataaacaacagaaatttatttcttacaatttcagggactggtaagttcaagatcaaggcactggcacattcagtatctggtgagggcccaactttcgggttcataaatagtgccttcttgctgtatcctcttatggtgaaagatgcaaacacactccattggccttctttcataaggacactaatctcattcttgagagtctggctcttataacctaattacatcccaaagacttcacctgataacaccaggactttgtagattagatttcatatgaatttgggggaggatacaaacattcagaccatagcaagagcgacatattctttgttgcccctaagcatgtaaccattcctacagtggttgtatctactggccttgctagtgaagcctgtaagtcatgtagaatgtactgctattgcttttctgatattatttaacaaagaaacctactcccagggcagccagcaatgttgacaacattttgacctctcctgaagcttccaggctgttttatacaatgaaggaagggtaacaggtcatcatgcttatctgatctataattcatttgattaatgttactgatcagctgcatcttttttttttttttttgcctctctgttgtaaattggtagggattgtagtttcttgttcactttggatttttccattacacatgcaaatggagatttttctttacataaataaatctttatgatcattttggttatttttaaaggtctggaacttttttctgtctctgaaagccctggacactcttttggtttcaatcaccctatgctgtatgtcactatttactcaccatttatataattaatataaatatttttcctcaatttctttttaaatacatttctcataaaacattttcacccacattgcttgctctagagcatgaccaatgttcatagtctttgctacaatatgttgtagaataccataatgtttgtgctgtctactctcatatttacttaatctgtcatcaaagggagcattgccgatgcctttaagtgaaccaatcgattatacagcattatgtttagcttccatagcagcaattttgttttctcccttaggaatcttaattctggaaatgaacattttatctagattcggaatgcttatttattaaatgcaaatgtatttagcttaaataatatatttataatgattcacagtaacaatgaaatgtataagacattttactagagtctatgatgattttcaatataatcacaatgaaatgtatttaaattaaaaatattactgtaaatctctcaagatgaaccacagagctcaatacaaaattgatgttcttaagttaatcagttagttaatgtattgccaaacaaactagaatagaatactatattatcagggcaactttgttaaatagatattcaactttttaaatataagaacatagtgtatttcaaccatcttttaatactaattttatgtatttttattgtacttattttgttttatttctttatcattagaaacagtaaaccaataattccaaaacaaagaaaactcactaattctttttattcttgttcattcctttttgtcctgttaatcgtacttagaaatacagtattgacatttcctgggctgcttttgtgtagagccttgtgctgatatataaacatagaaatttatacatagttttcattatatattagtaaaaaaataagtgaagtagaaaaacgggtaaaagacgtgtacagtaaagatgctgaacaaaaactcacgtgttttattttttaataccaccctcaggcatgtaattaatattattatcctcagaataatgtttaaaactgatcttttataactgttatttcagctctcatgcattctttttgctggagaataattgattcatctcattatttgccaggtttagaccttagtaacttgtacatccctatgataaaaattattttggaatggaaagagagatatctaaaaagggatgaaatcatgccaaacatcttatctctaacataaaaaaaattaaatttgaagccagaatttcagttccagttctacttttagcttgtgtgaccttgagaaagtcacttaagcatttctgagcttcaagtttctcatttgtaaagtcgaagtaagaaataccttttatgcctagcactcagagttcttgttggatcaaacaagatttgtacatttagttggaaaactcaacatttgtatctaaacataatgtattccagcagagaattactgtccaccattttcatttatacattttaaatagtgatttattgatgatcttcaatatgcaaggagcactgctagacactagggaaataaaagggaattaagatagtacccaaacacttcaaatcctcatgggcaaggacacgtgaacacataataaaatactttaatttcaattacagacactaatgggcaggttgttaatagaatgtttgccaactttaagtagttttataataaaatataatagtttaaaagaaaggtctattaataaaaacagaattaaaatatatatagatcaaataaagtatggaaatttagttgaaaaattggcattaatcagtaggaaaaagatgggcttctcagcaagtggtattgggatagatgaacagctatatgggaaaagagaaaactgaatctgttccaaatgtaacagaatcaaattctaaaaagatcaaaaatttaaattcaaaaactattatgttactaggagaaaacaaaggtgaattactctgtaacctcagagtggccaaaagtttcttaactgattctaaatccagaagcaataaaggaaaaggctaataaaggtgacaatatgaaaatttagaaaaaaaaactttttatactaaaataattgcaaatatttttcacttgttaatgcacaataacaaatggaaaatatttgcaatttttgtcataaacaaagggttgttatccctaaaatataaagcacttttaaaattaaaagaagaccagcaactctataaaaatgggcaagagacatccaaagatagtttgcataacataaatgcaaagggtccttaaatataggaaaagatgttccaattcactcataaaaatgctaattgaaatcactgaaattactattgtttatcagtaaggttggcaaaaacacaaaaggttgaaaacatacttgtggtaagcagaaaagtgacccccaaagatgtgcacatcctagttcccagaacttcacatggcaaaagagattttgaagatattaaggattatgagagatgaagattatcctggattactcagatgggcccaaagtaatcacaaaggtccttaccagtgaaagaggagtcagtcagaggagatgtatctgatgatggaagcagaggttagaacggtgtgatcagtgcctttgaaggtggaaggggactgcaagccaaggaatgtgggcaacctctacaagctggaaaaggcaatgaaatggattttctcctggagcctctgaaaggaatacaaatctgctgtcgccctgattttagctccctgagaactatttttgacttctgatttccagaactgtaagataagaaatttgtgtttttaatctactaaatttgtggtaacttgttgctatagcactaggcaacaaataaaatactcttaagaggaaggttgtgagaaaacaggcactttcatttattgttgggaatgcaaactgtacagcctctgtggaggagaattttgctatatttacatatacactcacccttagatcccacaaacacatctctgtcactgtcaaatattgtaaaaagatttttcagccctatttgtaatagcaaaaaatactgggaacaacccaaatatatattaatagaaattggttgaaagaagtgtggtattacgttgtactatgcagttgtaaaaaaattaaagttttcatcttatgctgtggaatgatctcaggcaatattgctaagtgaaagtggcaagttgaaaacaaatgtatgttactatttgacgaagaagagggagaatataagtatacctttacctacacatatatatttgcttttttaacaataaaatgataaactaaaaagtattatttgggttttcttttcttttttagtggttattcataggactgaaaagaccaggatgaaggaaatagggatggtaggtagacctaagtgtactttacttcgtagatctgaccctctagccctataaatgtattacaactatgaagttttactgatttaggaattcaaaatatttcaaatatgcacaagttagaattaatatgtgaatgaatataaatatgaatgactgaatcttatgagaatttcctaatttacagaaagcagttttcaaaactgatagaggatggagttcattaaaaatatttattcagaattcattatgacctcatcatcaagtaggggaatcagatgatatataattatactgcaaggaagatgatgaaacatccaaaagagagatttaaagggatttcagagaaatgagagtgcacttccacctaggagaataagaaagattttgcgctcattcagttagttatatattcaacaaatatgtactgagcccctattatgagcaaactctgttataggcagtagggttcagtgatttttaaaacagtcaaaaactcctaccttcatagagcttacatgcttataagaatgagggtaacagacaataaataaaagatgaaaagaactgataattgaccattacatttagtgtagtggagatcagtgttgaccatggcaagagcatgcacattcctatcaccaggacattcatagtccccctagatgaagacagacatttacataagcaagtactatgttgtatgatatgttgtacctattttaaagaagcctctatagcgcttgtagtacgttgagcactttaatagacagtgagtactccataaatagacaagaaaatgatagttatgcaaactaatgttagcaattattttgtacttatactgtccagcctctgatatatttatgcctagtattttaagtaagtagcgttcttttcattttctttgctttaccaatgaaattccatagaaacaaagtattgccaacacttttggaaatgaagctgtgctgttttgcatgaggactgttctgcgtgagtttggtcaagggctaaggtcaaatttgggagactcccttctaccatgtaatagtggcatgacactaggtgaattagtttacctacagctcaatttctgcatctagaagataggaataataatacctgtgttcagtgatgttgtgaacatgaaatgggatgcacatatggaagatttgatgttattaatcacatatttttgataataaaaattctctttaactagaagtcccttttttattatactttcagttctggggtacatgtgcagaaggtgcaggtttgttacataggtatacatgtgccatagtggtttgctgcacccatcaacctgtcatctacattaggtatttctcctaatgctatccctcccctagtgcctcattccccaacaggccccagtgtgtgatgttcccctccctgtgttcatgtgttctaattgttcaactaccacttatgagtcagaacatgcggtgtttggttttccgttctcgtgttagtttgctgagaatgatggtttccggcttcatccatgtccctgcaaaggatgtgaactcatcctttttaatggctgcatagtattccatggtgtatatgtgccacattttctttatccagtctatcactgatgagcatttgggttggttccaggtctttgctattgtgaacagtgccgcaataaacataagtgtgcatgtgtctttatagtcgaatgacttataatcctttgggtacatacccagtaatgggattgctgggtcaaatggtatttctggttctagatccttgaggaatcaccacactgtcttccacaatggttgaactaatttacactcccaccaacagtgtaaaagctttcctatttcttcacatcttctctagcatctgttgtttcctgactttttaatgatcgccattctaactgatgtgagatggtatctcattgtggttttgatttgcatttctctaatgacctgtgatgatgagcattttttcatatgtttgttggctgcataaatgtcttcttttgagaagtgtctgttgatatccttcacccactttttaatggggttgttttcttcttgtaaatttgtttaagttctttgtagattctggatattagccctttgtcagatggatagattgcagaaattttctcccattctgtaggttgcctgctcactctgatgatagtttcttttgctctgcagaagctctttagtataattagatcccatttgtcaattttggcttttgttgccattgcttttggtgttttagtcatgaagtctttgcccatgcctacatcctgaatggtattgcctaggttttcttctatggtttttgtggttttaggtctaacatttaagtctttaatccatcttgagttaatttctctataaggtgtaaggaagggatccagtttcagctttctgcatatggccagccagttttcctaacaccatttattaaatagggaatcctttccccacttcttgtttttgtcagatttgtcagtgatccaatggttgtagatgtgtggtgttatttctgaggcctccagttctgttacattggtttatatatctgttttggtaccagtaccatgctgttttgctttgccttttagtgtagtttgaagtcaggtagcatgatgcctccagctttgttctttttgactaggattgtcttggcagtgagggcacttttttggttccatatgaactttaaagtagtgttttccaattctgtgaagaaagtcattggtagcttgatggggatggcattgaatctataaattgccttgggcagtatggccattttcacgatattgattcttcctatccatgagcgtggaatgtttttccatttgtttgtttcctctcttatttccttgagcagtggtttgtcattctccttgaagagatccttcacatttcttgaaagttgttttcctaggtattttattctctttgtaggaattgtgaatgggagttgactcatgatttggctctctgtttgtctgttattggtgtataggaatgcttctaatttttgcacattgattttgtatcctgagactttgctgaaattgcttatcagcttaaggagattttgggctgagatgatggggtttcctaaatatacaatcatgttatctgcaaacagggaaaatttgacttcctcttttcctaattgaataccctttgtttctttctcttgtctgattgccctggccagaacttccaatactatgttgaagaggagtggtgagagagggcatccttttcttgtgctggttttcaaaggtaatgcctccagtttttgcccattcagtatgatattggctgtgggtttgtcataaacagctcttatgattttgagatacgttccatcaataactagtttattgagagtttttagcatgaaaggctgttgaattttgttgaaggccttttctgcatctattgagataatcatgtggtttttgtcattggttctgtttatgtgatgtttacctttattgattagcgtatgttgaactagccttgcatcccagggatgaagccaacttgatcatggtggataagctttttgatacgctgctggaatcagtttgccagtattttactgaggatttttgcatcgatgttcattatggatattggcctgaaattttcttttttggttgcatttctgccaggttttggtaaccggatgatgctggcctcataaaatgagttagggaggattccctttttttctattttttggaatagtttcaaaaggaatggtaccagctcctctttgtacctctggtagaatttggctgtgaatttgtctggtcctggacgttttttggttggtaggctattaattactgcctcagttttagaacttgttattggtctattcagggattcgacttcttcctggttttgtcttgggagggtgtgtgtccaggaattttccatttcttctagattttctagtttatttgcatagaggtgtttatagtattctctgctggtcgtttgtatttctgtgggattggtggtgacatcctctttatcattttttattgtgtctatttgatccttctctcttttcttctttattactctggctagaggtctatctatttcgttgatcttttcaaaaaaccagctcctcgattcattgatttttttgaagggtttttcctgtctctatctccttcagttctgctctgatcttatttcttgtcttctgctagcttttgaatttgtttgctcttgcttctctagttcttttaattgtgatattagggagtcaatgttagatctttcctgctttctcttgtgggtatttagtgctataaatttccctctccacactgctttagctgtgtcccagagattctggtacgttgtgtctttgttctcattggtttaaaagaacatctttatttctgccttaatttcattacttatccactagtcattcaggagcaggttgttcagtttccatgtagttgtgcagttttgagtgagtttcttaatcctgagttctgatttgattgcactatggtctcagaaactgtttgtcatgatccgttcttttgcatctgccgaggagtgttttccttccaattatgtggtcaattttagaataagttcgatgtggtgctcagaaaaatgtatattctgttgatttgagatggagagttctgtagatgtctgttaggtctgcttggtccagagctgagttcaagtcctggatatccttgttaattatctgtctcgttgatctgtctaatgttgacagtggggtgttaaagtctcccactattattgtgtgggagtctaagtctctttgtaggtctctaaaaacttgctttatgaaactgggtgctcctgtattcggtgcatatatatttaggatagttagctcttcttgttgcattgatccctttaccattatgtaatactcttgtctcttttcatctttgttggtttaacatctgttttattagagactagtattgcaacccctgcttttttttgttttgcatttgcttagtatatcttcctccatccattcattttgagcctatgtgtgtccctacacatgatatgagtctcctgaatatagcacactaatgggtcttgactgtttatccaatttgccagtctgtgtcttttaattagggcatttagcctgtttacatttaagtttaatattgttatgtgtgaatttgatcctgtcattatgatgctagctggttattttcccctttagctgatgcagtttcttcctagtgtcgatgttctttacaatttggtatgtttttgcagtggctggtaccagttgtttctttccatgtgtagtacttccttcaggagctcttgtaaggtaggcctggtggtgacaaaatctctcagcatttgcttctctgtaaaagattttatttctctttcacttatgaagcttagtttcgctggatatgaaattctgggctgaaaattcttttctttaagaatgttgaatattgtcccctactctcttctggcttgtagggtttctgtcaagaaatccactgttagtctgatgggcttccctttgtgggtaacccaacctttctctttggctgcccttaacattttttccttcacttcaaccttggtgaatctgacaattatgtgtctttgggttgctcttctcaaggaatatctttgtggtgttctctgtatttccagaatttgaatgttggcctgccttgctaggttggggaaggtctcttggataatatcctgaagagtgttttccaactcggttccattctccccatcactgtcaggtacaacagtcaaatgtagatttggtccttttcacatagtcccatatttcttggaggctttgttcatttcttttcactcttttttctctaatcttgtcttcttgctttatttcattgggttgatcttcagtctctgatatcctttcttctgcttgtgattcggttattgatacttgtgtatgcttcacgaagttctcgtgctgtgattttcagctccatcaggtcatttatgttcttctctaagctggttattctagttaacaattcatataacctttttttccaggttcttagcttccttgcattgggttagaacatgcttctttagctcgaaggagtttgttattacccaccttctgaagcctacttctgataattcatcaaactcattctctgtcccattttgttcctttgctggcgagaagttgtgatcctttggaggaggagaggccttttggtttttggaattttcagcctttttgcactggtttctccccatcttcatggatttttctacctttggtctttgatgttggtgatgttgatactattcctttctgtttgatagttttttccttctaacagtcaggcccctctgctacaggtctgctggagtttgctggaggtccactccagactctctttgcctgggtatcaccagtggaggctgcagaacaacaaagattgctgcctgttcctacctctgaaagctttgtcccagaggggcacccaccagatgccagccagagctctcctgtatgaggtgtctgtcggctcctactgggaggtgtctcccaatctgtatacacgggggtgtcagggacccacttgaggaggcagtctgtcccttatcagagctcaaacactgtgctgggagaaccgctgctctcttcagagccgtcaggcagggacatttaaatcactgaagctgtgcccacagccgccccttcccccaggtgctttgtcccagggagctgcagtgggctccgcccagttcgaacttcctggtggttttgtttgcactatgagggtaaaacccgcctactcaagcctcagcaatagcagaatacttttaattcttatgggtgtacataaatgttaaaatacattagcttatttttgtactttatagagtagatgcaacagaatcaattttgtttttataaaaaaacttttggttatgtaatagtgtcaataacaaaatatttgtattacaattttaaaatacttcattcaatctttgcaacagcccattaatataggcatttatactaccttaatcttatagagcaataaaaggagctcagaaatacaaaaattaatgcctataatattgtattattttgtttacgcggatgcaggaagtctgggttaggctgaatatattttgtcttgaggaaattggcatttttaaataaatttttgttttgatttacctttctctttaaatcagggtttctcaactagtgacactagtgacagtttgcactagtgaatacatatttgggttgttctatgagaaaacataagcactagtgacatttcgcactggtgatccattgttgtggagggccgatctgtgaatggtaggatgtttagcaccctctctagccactacccactagatgccaggaacacacttgctccatttgtgataaccaaaaatgtctcctacccatattgtcagatgacccctgggggagtgaccaggggacattagtgagaacgaatgagtgaggaaaaagtgagaattagtgagatgtgttaaactacagtagagcaaagttttaattaggttttgactaatgttttcatttgtattaaaaagtaaagatgataattttaaagcattttatgatatagtcactaaatatttgagtaaataaaactttttttttttttttaagatggaatctctccctgtcgccccggctggagtgcagtggcatgatcttggctcactgcaacctctgcctcctgggttcaagtgattctcctgcctcagcctcctgagtagctgggattacaggtgtgcaccaccacacctggctatttttttttttttttttttttttttgtatttttagtagagaccaggtttcaccatgttggcagactgatctcgaactcttgacctcatgatctgcccacttcagcctcccaaagtgctgcgattacaagcgtgagccactgtacccggcctgagtaaataaaactttctaattgtgaacactttacattgatctgataaaatttacagaaataaaaatgtgaattttagtcaaaacaaagaactatatataatatatatttttccatgtggctcattacatatgattttaattaatactttctacaaaacactgttcattactcccctttccaaaaaaaaagactaaactcttactaaatatatttgtggttttggttttaatggttttgtttttggttttacaaatactgattaaatgttagtagggaagaagtttagttttattttttgctctagtacatgtaatattctataaattttattgtgatgacatgacattttcctccttcaaaaagacagcagatgaatgaaaaatatatttttacgtattcattggtactgaattttaaataaaaataatttataactaattttaaacattcctaaatggtaagtctagaagacttttaaaaattgaataaaacaatttacagtttaattatatgacttagtagagcacattatttcctattatcctattaccctgattgaaagataaatataaatgttgggttattgttggtataattaagccattgaattgtaaacatctttcttctgaaacaatacacacacacgtatataaaaaacaatattattcttattagctatgaataaaaaatacattcctatgtatatactggatttcagatgacagaaacagatagaagatagtgtccaatatttttgttctacttgtttgaaaggttatcaagtagtaagtaataccagcagagcatgaaaatgaccagtaatttaaaagtaatcagacaaggtatagtttgttgtatttttaactacagaaggctggtcaatagctgcactcaatttgctgttatttccccatggaaagcccagtttgttagctttaggataggcgcagtcaatagattcttttttactaagagaaatgatccatgggaggtctcctaaggagtaaagtcatgagaaaacataggcagcctttcatgctgcacaacacaactagggaagtaagactctgacctatttgaggtagcgtttcaaagactgcactgttggagctcttttttaaaaaaatcaaatcatgtaatcaaaagaaagctgaaaataatagcaaaaggctagttttattagaaaacttttgttctattataataatgcattatgtgaagtgcttggaattggcctcaaatactgttaaaacacatattaaagaagccaataattacactttgtaagtttgcctctttgtgggcaccctttgtcatctccttgtggaataatttgagaggtggaggagacacatagacattgggcgaggtaaggaaaaagttacaacacacattccagtgctctaagacctcattggaccacctgctgatccagatatgtgtatggtggagacacaaaaatcataaataacttcccccccagttaaatatcgctgcaattaaattctccatttgagaaaacaggattgaagagtgatgcccttgttgacagcatttattactgtgggctcacctacttccaaaaaagaattgagatgacttacaatgaaaaggaaggacaaaataacagcacatttgctgttgctggtggtgttggtgttgggttttgttttgttttgtgagtggtgtgttagaataaactttggagtcacagcagctggataaaaatcctagctttttctcttataagattttgacttgggtaggttaattcagttctttgaactttgtttccttaaataaaatcaggcacaataatgactaattcaggattgtggtgagaattaaatgagctaaaataggtaaaacacctaggatactacccaaaacaaagtcggggctcaacaataaccattactttcctcccttaagaagatggagattttaaggaagcttacccacaagggctcttttctctttctctgtcaacttattgtcttttaagtatctaagatcacaataaacatctccaaattatgtaaaaaagaaattggccattgtcagaattcattattcaccaaagcttctctgagcacttgctccatgtatgacacctcacacatgaactctggggaatatgagaagtagctggcatgccccagccccagcagaaggctctttgctgcttggaaaaaggaattcaaaacactaagtttccttctttcttctgtttcaaaaactattaatagatatgtcagtaagcctgaaagttttattcctcctggctcagactgcactgatgacttcttcagaaagcctgcctggtcttttggcagatttgctaggatttggatgacctcatccatgatggctaaaagtatatagaagggtcagattaatttaatgcagaaaatctagtacatcctagaaaataatgaaaagttcaaaattaagaattcattgatggaaccagtcatttaatgtgagaagaaacaacacagtaatatagaactcagtatttaaaaaataatcagtacttatgaattattttcttaaggattaacttagagaactgaaatctgccatgtaatttatctagattgtaacatgatttggggagaaagggtacatttacatcccacctaaaactaacctcccataaatagtatataacattatataaattataagaatacaaattactccatacttgagaaagttactatcaataatttatattgacagattctaatgacataaaagttttaaatgtaaccagttaatcatcaacataattattctttaataactttacttttgaatttcttcagtggcttagaaaatgaaagcatacaatttttctaactgttgaaatatctttattcatttttgtttaaatttttgaaatgttctttcttaagttaaataaaaattatttagaaacactaataggtaaaatataaaggtatattaaaatgtgatcagcactttttatggcatttgtataatatttgataaaatttcagatggattgggaaggtttaaataatttatctaagttgtaaaagttatcatgcaataaatatactcagattcttatcagtgagtttttttgttttgcgtatatattttactctatgcagtttgtatcaaaggttaagattcatccatgaattaatgtatttatttattcattcatttattcatcattcaaaaatatttattgaacaactcttttagaccaagatctatgttaaatctggaattggaaacatgaatataacacaggccttgctcctgagactcacataatctactaagggagagacacagatacttgaccatgtgacagtacatacatagagaaatgtacgtattctctgtgaacaaaaagaaaatagaaactaattatgctcaggagaagtggggtaattatttcaatgagagggcagtatttgagcaggatcttgaaaaagaaaaaagataaatttccctagtgaacagagggcattccattcaagagggaacatgatctggttggcctagttgtgacatggagcctaaggaaaatgatgagaggcaaggaaggggagtcggggatgggcacaaagattctgaattctgtagacagtgggggactggagaagacttctaagcacaatcaataagaaaatgtgtgtgtgtctgttatatgtatttagaaagatatctgtgtgtgtttgtatacacacatatccattaatgtatatatacagacatatacatatgtatgtatgtatttatatgtatttttgtatttaaaaatgtatgtatgtttaaaacttctatagcatggaaacacttttagaagaaatattgaattgttttagtagatactaaatgcctattacataacattcacgttaaaagtttgaaagaaacagaagatgatacggtgaaaatgaaaactaagccattcttctatctcaattttctagccacctacttgccttcctagaggcaatcactgttttcgggatttttgtgtttctttgaggtattgtatacaggtactagtatttgtgttctctgctttatagatgcagtgttcttaccttgctagataattccatatcagcaattaaggaacaactacgtttttaaaaaattaaagactttatttttttagagcagttttaggttcacagcaaaatttagaggtaggtactgagatttcctatatacctcctgcctctgcatgcacagccttcatcattatcagcatccccaccagagtgacacagttgttacacttgatgaagctacattgacacatcataatcatccaaagtccattgtttacactagagttcactctttgagttttaccttctgtgggtttgggcaaatgtgtaatgacatgtatttatcattatagtatcatacagagtatgttcaatgccctaaaaattctctgtactctgcctatgcgtccccacacccactcctgctcccaccaacccctggcaaacactgatctttttactgtctccataattttgccttttccagaatgtaatatagtttgaatcatacatttctatgattattgtgataatatgtagacttttcagactgtgaaatgtatattcacacagaaatatacatttaagtttcctccgtgtcttttttgtttgtttgtttttttgttgttgttgagatggagtctcactctgttgcccaggctggagtgcaatggtgcaatcttggctcactgcaacctccgcctcccacattcaagcaattctccctgctgcagcctcccaagtagctggattacaagtgcctgccaccacacccagctaagtttttttatttttagtagagacggggtttcgccatgttggccaggctggtctcaaactcctgacctcaggcaatccgcccgccttggcctcccaaatcgctgggattataggcatgagccaccatgcccagcctcctccatgtctttttatgtcctgatagctaatttcttttttagagctaaataatatcccattgtctggatatatcacagtttatttattcattcacctactgaagggagtcttggttgcttccaagttttgacaattatgaattatgctgctacaaacatccatgtgcagatttttgtatggatataagttttcagctcctttgggtaggtatcagggagcacaattgctggatcatatggtcagggtagcttagttttgtactgccaaactgccttccaaaatgactttaccattttgcattcccgtgagcaaagaatgagaattcctgttgttttatgtatttgccaggatttggtgttgtcagtgttttcgattttggtcagtttaagagatgtgaaatagtatctcattgctgttttactttgcatttctctgatctacagaacatcatctcatatgcttctttgccatgtgtgtatcatctttggtaaggtgtcagttaacagtctttcatccattgttattgttgagttttaagagttcttcatatgttttggataacatgcctttatcagacgtcttttgcacatattttctcccagtctgtaacttgtcttcttactctcttacattgtctttcacagagcataagtcttcaattttaatgaagtctagtttatcaataatttctttcatgaattaagcctttggtgttatatgtaaaaaattattacagtaccgcaggtcatctaggttttctcctatgttatcttctacaggttgtatcattttgcattttacatttaggtctacaattcattttgagttaatttttgtggagggtactacctcacttgtaatggctgtatagtgttccacagtactatattcaactagtcccccactgatgtatacaattagactttttccaatctttagctattgcaaacaatgcgacagtgaatattcttgtccagctctccttattaaccatcctttcccccccccggctcactaaagatcttatcatcatctaacatactatgtattttctttattgctttcattatcaaacttcactcctgtcacatattagcatgttagatccaaaaagcagagattttttttaatttgtttcctactgtaaccctagtcatagaataaatgtttaatgaatatttgttgattgaatgcctcttacacaagtatatctacaggaaaaaatcatagaagtcaaattgctggttcaaaagggataggcatttgtaattttgacagatattgccaaattgatcattatagaacagagcatttcaaccttgacactactgacattttggcctgataattctttactgtgtgaaggtatgtgctgtaggctgtttaacagatcctccagttgtgacaaccaaagatgtttccagacattactaaatgtcccttgttaagaagcactgattgttatgcaacctttgactctcactgacaattatgaaaatatctccccacagccttgccaatatcgtcttttaggaaacagttcactctgaatatctaatggtgaaaagtagtatctcatagttttaactggcatatgaattcacattttgatggaactttgctgtaacaaatccccagcactgtacattgtaatgatgaaggtaagtttggttttccactgtagagggaaggcgggggatagagtgaagatatgaaatccacaatcaagtgtagaaaaagtgctttttgctcttatttttcttcgttaaaatatctgttttataaatcctttcttatcttcagactattatgcattcatgggctgaatcttctctagaattatatcaactggccttgattaatgaacaaaatttggagtcaaaagccttggaatttgagtgcaggctctcctaattactagttgtgttaccttggggaagtcacataaactctgagctgcaatttactcatctgaaaattgtggataataacatttgctctctctacatcactgagttattgtaagaattattttttagactgcaaagcctttcacaattgcaagggtttatgataattattatgaaggttttatgacccgctgctttatctcatgactcacagtgtcccgagagtttttctcttctcagtgcttctgcgatcacctcaaactgttctcactcatttatttattaaacatgggcattgtgtagccttaccatatcttcaactctgtagcctaaataatttcagaacaattctcctcctaactgaacaagtcccagatagactcatcatttattcagcattcattaaataagtaccattgtcttccccaaaactgccttttcctcccaacagccccatttttgtcaatgccatcattttttctagtcttgagggtgggaactttgcagtcatctcttgtgcttgtgctccctgtcccatggatcctgcataccacaaccagattaaagtagactacctccttcttcaggtcccttcttgtgattataagctgagagtcccctgttgagtgccacatcaaatccaaattatatttcagtagcactccttgttacccatattctcctaaactactttttctttccttgcaccagactcattcttgcacctatgcttttgttcatcatgtttttctccctagaattttcttcacctgttcctttacctatcaaccagcaccaactttcaagacgtctatcatccctattactctatgttctctttttctttatagctcagcttactctaatctcttttatcacttcactctcattgttattggtcagtttaacttaatgtatcatagtggatctcaatcctgactgcatatcagaatcacctcagtaaagttttgtttgttgtcttaatataatcccaggatcatgattggggattctaattctagacagagctttgttattataattttagtagagtggtttgaacatcttcatggatattttaagcaggtcatttttctcttccagaccacagatttataaatttactggtagtaagaatgttaaagacatcaatatacccaatgctcaataattgattaactgatagtgtgatataaaaatatttcttattcatttcctgcacagcctataatttgtgtgctacctcttccagtttgtggctctgtgactttgtataaattgctgaatctcttaacctcatgtttctttgtatgtaaaatgagaatagtaacatatatgttgctaattatgagaagtagagctaatgtacataaattttcagagctacatggtggcttttttattactattaatactatatagtctctctgctgttgtagagatgcttaaaaaaccctttttctttcttgctttatgatttgctattttatgacttagtagatttacttatttacattactattggaattaagacaggatatcaaggccctatcaaatcaccatgtaatttgatacctaattacctttgatacctttgaaacctaattacattttcatattttaaggagcaaatgagtattctattttttgaccatcgttctactgactgttttcttggttacaagagaatatgcaccattacagtttttccttgtcagcagcaactccacgccgtgaacacgctaactttatgtatcttcttcactttacctgacattgccaagtaggtgtttcttcctcctaactgtaatttaaaagaggatatttatttttaacttagctcattttattttatttcatagtttataactatcccatttaattttaaaattaaaggaatataatactattctattaaatttagacttacagattgtgctcctgggatcagcaagaaaacataaagtactttgtttccacaaaagacacttcctatataaattatttttattattaagttctgtatctttaaatgagtcacttttaaatctttttcttgtcttactagtgaaaaaatttaaattgtattattaaaggaaaacatatagacatatgaatgagaaagtattcattaataacttgtcttcattaagttagatgaaaacaataaaaaaggaattaaccaaagtggcacattgccaatcataagacaggagaaagtttccagagcaattaaaggaaagaaattatttgttcaaccatggacatttatactgttttttcagtttcaaagttgtaaaagtaatgtatggaggctatcttctcctgcaccaaaacaagaaaccgtataggtttctttggaatgcctattaatcatgcattgctcccataaattagtcaaagctaaagaaaaagtgttgctaaatagtgcacattttcatttccctgaatatttgtagctgcaatttatacagataccaacaacactgtgggctcagaattaaaatgaaagtgcttgaaaacttgtgtgaattacctttcttacagtatatttatggagccaaacagacatatgtttgattctcatttcatccgtaacatgaatatattgatacttactttataaaattattgaaaggattacatgcatttaccatggtgcctggcacatagcgctcagtacattgtagtaacgggctatgctgttttgagaagattgtgtggagagaggatatcactgactttggagttattcatgcctggttttatattccagatctatcatctgataactggctgatttcggccaaattactactctgaatttagtttccttgacaataagctaaagtgaaataacagcaacctcatagggtggttctgaggatttaataagatcatacatataaagggcttccaatgcctgttacatatcatatctttcagtaagtagtagatcttattactcttattcttactgctaaaatctgtgtcttaggttcttgacttctttgtaaatatgcctttgaacaatgtggaagggtcaaacaactattaccccaggagtatattgactttgaagctaatgcagcttaagcctaagggcctctcatttgcacaagtcccttccaaactgacacttaatactcttcttaattttatattctctttcttaaagaagacctccgaagctccaaaaatttcaggtttcagaaaacctgggtctaggttatactattacctgaagggttttttttttaaaactaaaaaaaacaagagaaagtttataaggaagcacaataatgtatgctatctaatgaatatattgatagcaatatttatattaaattgctattttaagcctaaatcctataagttctattttgtgcattcagcttcaaaatgattctactggtaataaaaatggcatactaagcaatgaaaataagagataacttgagtacagcaataaaactcaaaggaaatgtaatcagtgatacagaattatgtaattttgtatactcaatattttctaagctacttttcagaagaaaaagaatagttttaaccaatcagtgagaaaggtaactgattaagcttattcaaaataaatatctgtcttcctcaaggcaggctgtgtcaaaagcatattgaggcatagatcttccaacaaattataaattaaatgtccattactcacacatgcaaaaattgaagttgagaaaattacataactgaagtcaataaaacaaactctggtattatataaatacactgtaatccacagaagatatattcatgtttaaaatggttagcttcaaatttttgagaaaaaaatacttcaaggtctttctggtaacatcagttggtaagttagaataaaaccttaataaaaccagtaaaaagactttgtaatttgcattgctcatctcattctttaaaagaatttattgatagattttctcattatacctacatgttcagtataaaatatgaaaaatatccaaaacgtttttaagtcaggtgcttttaaaatatgtggcttccccttgaaaagtatatatctactcaaaatatataaagtatattaaaatttgttcatcttaaaacaaaattgcaattttatgagacaatattaacttttgaggacgtcaaatgtagaaattgaagctcacagttaataacagaaaggatttgctaccatttatcaaataccttaccctggtattatgataagaaacatcattcccattttacagacaaagaaatatcagagcaaccagggttaaatgactttaccaaagttattattacaaccaggactagaattcataggattcttacttttttttttttttttttgagacagagtctcactctttcgcccaggccggactgcagtggcactatctcggctcactgcaagctccgcctcctgggttcacgccattcttctgcctcagcctcccaagtagctgggactacaggcgcccgccaccacacctggctaattttttgtatttttagtagaaacggggtttcaccgtgttagccaggatggtctcaatctcctgacctcgtgatccgcccgcctaggcctcccaaagtgctgggattacaggcgtgagccaccgcgcccggccagaattcttacttcttatctgcctcttaatcttgttaggtcaaaatctctcagcatttttagaaaatgccttttttattatattttcagcagatcatgagtctaatataccagcgttacccttttctatgctttccttccttgagaacgctttcaggagagaaatcagttatagttttctgtctcttccaaatagttaaaaacataagagatcatagatgtagtaaatcagtttagaatcccaatgccttgattgggatgcttaattttactataatagcctaatctgaaatgttatctgaaaggcttatttcttcacattcttttctacaccacaaaaattgttcataacaagaacaatcttgggggaaaaataagatgagatgttttagacagcttaatggggctgccactgtcttggataaccactgtttagagctgtcttggattagctgaaggctagtgttgactgaacatattgaacaccatcttaagttgtactttaagtcaggatagacagtccttacaagaaatgaaagctgctcctttgaccattataggtgttctgtggctagagatgaagtgccacactaacagaacaaagcttgcaatttgtggaattgaattccaaggtgaaaaagaaggttaacaatttgtgtaaaatcctctctcaagaacagaaattccaaaagtattgattacaatattcacaatggcatttcacactgtggctggtgcttttaaataggagtcagagaaaatatcatgttgcttaatatttaggcaactaattacaaaattctcgattaccaagtctcactgaagtgttcccttacgaaaacgtgaactttattaggtatcaactcattgacatggtccatttgaagaagcaatttattagtctaatggttaacacctgttagatgaagctcaaaaatgaaaaagattttaatgaaaagcaaatgcagtaaatgctagcttttaactggtttcataaaagattgaatatatattcaatattctgtatatatatatatactgtataaatatacaaaatatatactctgtctgtgtgtgtgtgtgtgtgtgtgtgtgtgtgtgtgtattacacaaactctccttttccctggacaatttaagtacattttccctgtaagctaaaagccataagtatccctacagatattttttgcaagtgaaattgcttttcatttggcaaaaactaaacctgtgattcatagcagcttagagcactcaaggccaaagagtacatcttgcttgctttgactgacatttttgcaggctaaatcagacctgcatgattcagctgtactgagattcataatgctgtgagcagagaaatttgggggtggtataaaagagcatggagggaaattgtcttggaaattgtgactactgactgaggcaaaaatcaaccacagccaataggcggtttcaattgatatttgattggggaggcgttttcttgctaccctctttatacaaagaacattagagaaattttagtgaagaaaactactacggaagcagaaaaagagggactttactatgagaaatgaaactgcaatagggagcaagagcagggagaatgactctttttaacagttgtcagctcaaatattaaagggaagtgcacattgtatataaaaggaaaagtggcaaaaaatccattcccaaaaaatttctcctaaatgtctaccattagcaattcattcctttcagatttcttcattgagttcattcctcagttgcccttaaaattcatatgcccagaggagtaaaaatcttcctacatgaagttatttcctatctggactacaaagggagcacaagaaaattgctttgggaagttcaggcctcaggaaaatacggtgtttaaaaaagattactatatagcttatgctaaccaacacctcatttttgcttaatatttattttattctgtctcactagtaatatataagatatagcccagtcataatggatcttattcaggtatggctacgtaatctatggtacaaaatgtaagtatgagccacttattaaacaaattattaagaatttcagcagagcattcagccaagcttagagcccttctaagactggggacccctgcacctgcacagatcacatgctcatgaaatcagccctcattttatttgatggtagtgaactgtgtgaattccaaacttagttaatgaaagtgtttcgttacagattacctaaatattttggcttgtaaatgctcaacacaaatattaataccaaaaattcaaacccaaattctttttgggttaattggaggctttgcaaatcactaaatttaactatttgttcctatctccctccctttttgtgtgatcttctatgggaaagtataggatttatgaggttacacattatcatttcagatttggacctctcccttaaacctgaggttcaagagcctaatcttcactctctattcctaacttatgaatcatctagctgaaaatagccaaagactgctctctaatagccaccccaaaccagcactcatcctagaataaccaataatttccccagccccaggtgtggagttaggatgagtgtggataatacctggttgtgccaaacactaaaagtagattcactttgggaggccgaggcgggcagatcacctgaggtcaggagtttgagaccagcctggccaatgtggcgaaaccccgtctctactaaaagtacaaaaattagccaggcatgatggcaggcacctgtaatcccagctactcaagaggctgaggcagaagaagcttaacccaggccacggaagttgcggtgagccgagatcacaccactgcactccagcctgggcgacaagagcaagactccatctcaaaaaaaaaaaaaaaaaaaaaaaaaaaaattagattagtgaaagctaggggtggctttgggcaaggtgctctgagggcccagataatagggaaattaagcctataagagtcttgatcacctaagctataaaaaacacttctgggtagaagaagtttttacattccaattcaaacttgagtatgctgctgtttaagccaatatttatttcctcttagcatatgtttcaactttagtaccgtccaacaataagatacgtattctctattaaaatctccctcttcatcttttgttgacacagcactataattagtatcacataattcctaccactgacagaatgccccagaatattttgtcttatttttttttcaagattagctagcacttataacacttcttgctaacgtttcactcagttatagttggagttagtgaagtcatggtttgtttttttttttatgtaaagctgtcttttcttcttctcacccccatcccacaggcatcaaaggaagttaaataaaagaatgactattgtgacgttgactaatagtcataagacattagctaagaaatgaataccattgaggttttgaatgatcagctgttaatttttaagattatactttagaaaataataaatcctgcttttgatgagatgtccattaaaaaacttattttaaaagtaatatattttgagtaactacattctgtccaatgcaactctaactgcatacttctgaaatgtttacccccgaatgatcccttctaaaacatatagctttagcttgtcagtttactggcattgaatttcaatacttaagttaaaatatattgaatcagctttgcaatacttggctggatcttttagaatagtattattctttcatcttacttatagaaaacacctaagtaaaatagtattcatttttaaacttcaatttattgtatacagagctttctttcttaatagattgacttcaagaaacattttttcttcaatcagaaaatattgacttattcttctgaattgaatctgtataagatttaaaccttccagttattacccaatataacaaaattaacatgaaaccaaagctctcgagcaaaagttataatatttgaacttaaaaagacaaatatcctatatggacttcaaaatatataataaatcttaaggagtcagtgcaataatttttttaaagcacaattttatttaaggtacaataagggtttaagaaggagaaaatgggccaagcacgatggctcatgcctgtaatcccagcactttgggaggccaaggcaggctgatcacaaggttaggagttcaagaccagcctggccaacatggtgaaaccccgactctactaaaaaaaatacaaaaattagccgggcatggtggcatgcacctgtaatcccagctactcaggaggctgaggcaggagaattgctttaacccgggaggcggaggttgcagtgagccgagatcgcaccattgcactccaacctgggcaatgagagtgaaactccattctcaaaaaaaaaaaaaaaaaaggagaaaatgaatttacagaaaagtcgaatattcttttattaaagcagctctgttatacaagaggtaacactgttataggctgtctgctttcttgatgacatagccaattagtttgtaatctaggcagttatcaaggttaatcacaaatggaagacaatacatatttaaaataaatgagatagttcaggaataagtggtatattatctagcgagtaaattcagtaccaaaatcagtctctaggatcttactccaaagtagaccttggcctccaattatataaagcgtatgttaatctggacatggagtatctgtagctaaatagtatatgccactaccaagtaccatttggcctccctagaagaatgtgacctgatgaagaataaagaatatttcataataatgtacagttgctagataatcttacctcttttggtagattaaagatggcttcaaattctttgacacttcttctgttaagaggtggggtctaggtctcttcctcttgaatctgggtgggatctgactgtctgactaacagaatgtggtggcagtgaagtttgtcagttttggggtccaggcttgaagacaatggcagattcccctcctgtctctcgtaatattcattcttgaaacgaagctagaggctcgtacatcttaatgtttgaagagacctgtgtgcaaaggaaccagtgtccctgctgacagcccttgatgagctgacagctgacagccagcaccacctttcttggcctatgaatgtgttatcttggcaaagatcttgagagatgagccacatctccaagccctacccaaattagattcagttgtattgggaattctgggattggttactgccatttgcagcagggttagcatcttaagagtgcaggagaagggccaggcgcggcggctcacacctgtaatcccagcactttgggaggctgaggcaggcagatcacttgaggccaggagttcttctcagtacagataagcataaacattaattgtaatacatactgaaggttttaaggatgaaatgtactgatgtctctaactttgaaatgtctcaaaagaaaaggtggattaataaaggaacaaactgatagatctgtgatgaggttgtgataaagcaaatgtagcaaaatattaagaattgtagaattgaggtgataggcatatggtggttaatatacaattttacttttttgcatgcttgaacatttcttttatgaaatgttgggaaaaacaaagatgtgaggtgtttgacacctagtaaacattcaaaaagtacaaggattttaaaattgttactagttttatatttactagtaactgaataaaataaagtatttatatagcttcatttccttgaaaaattcttctaaaatattaatttcagtataacttgatatactaaaatatcaagttattgatattttaccaattttgactttgttatatcaagaaatgtaaagtcttgctaagcaaatagtatatttcctgtaatagatcttgaaattcagtaataatcctgtagcactaagaaaaattaattgacccaaattccatggtatttgatgtattttaagataagttttactaaatttaaatttaactctagtttaacacaagaaagaagaaatccagcatacaattctaactgaatatactgttttcaaataaacagttcatttaacaaaaactggccctgtgctagatgctgtgggacagaaaattgagctgcttaacacaaggccctcacccacaaaaggctttcagtgtggttaggaagaaatatgcaacccttggggaaaaaaggaacaatgcgtgagttaaaaatataaaacatgtaacaaagaagtaaatgattaagaatcaagtgaataatatagataatatgagctgagagttcagaagatgaaaaaaatcattatagccttgaagtgaaaattttgggagtttcactgcctatttaagccctttggaacatgaaagaaacttattgcgaacttgtggttttggtagaagacaaaacacaattgaataaagagtaatgttcaggggccggactttctttgagaattatggagaggagggaagaataaaaacagaacttttagccgcaatcagctagaaattgtagctgaatattacaacctctcttcctttcaagagatgcttatttattgtctggttcatataaagcattaggataggtgctgagggttactatgaatgaaatttggccctaacttcaagaggtttaagagtaacaataacaagagctatctactagatgacaagagtatgccaggctagtcgaagcttatggcctattagaagaggtaaggaaaaaaaactgtaatatagaaagtataaaatgtcaaatgccatttaaaaagaccagataaaatgctaagtgaattcagtgaagagttttcttatagttgtataaaggaggataagtatttatgcaggaggtaacactgagttggtctttaaagagcaataagtagattgtgaacagagatatggtgaaagagtaaagaaagggataagaatgatccaatgaacgaactaaatcatatgcatgacatcgaatatgtgattctttccagctacagtgcagactatggagagaaggatgattgaaagggaaattgggccagaccgcctaggccttgaataccatgctgagtgtcttgggctttattctgttggcaacaggaagacattaaagaattatgacctgaggaatgaaaagttgagagctttttggtttttattgtttggtgttagtctggtagcttgtgtaggaggaattggaggaagaaaaatctagaggcaaaatgaccacaaggcaatgaggacgtgaaccaaggacactgaaggagctatttcagaggataaagggatataaccttgcaaccaattcagtatcaagagcaacaggacagcagagtataccaaagtggggttcagtaagttattgacattgtttagaattgccaatacatgataataataaaaagccgactagtttttagttatattattgttcttaaattccctagaaacagtattccttttgctgcctgcacccagggcagattgctcccaatgtcccccacctggtaggccattgcatggaagcagaagcacttaaagaagcttcagaaattcaagcttagcacctgggagtttgatggtgcttctaatagaaatggaaatcaggaagataaaagcagatttgggaatgagttcagttttatacatgttaaatgtgagttgtggttggctggccaattgataatgcccaacattctcaatgtgatagtggatgtaactcagctgagaagttaggacagtgctctaggtcagcgagtcatctgttaagaggtggcaattaaagctagcggaatgcctctaggtctgagggagttaatatttataattgagcatctacaatgtcactcacatatctggtctctaaagctagtggatcttaagccaaacaatactcaatgtgcacaatcaagggcacctaccagaaatttccatcttgaatttcattccttttggctcctgccaaaagtacagctgagataattggcacttgaaagctaaatattaggaggactgtgcatatatccttttttattttttctaaattctatcactacaacttaattatttgtgcctaaataactataaatatcagaaaatagattacactgaatagattagaacttagcttttacaggaaatactctcaatgatttagaaggtaatgttctgccttagccttcctctagggttggtacaaaacatatagaaaatgccaatgtagtctataaaactagtatgaaacatattgtcttatacacacatgatatgtcctggaaaaatggttctttgagaggggcaaagcaagatggccattgatcatccctactgcaggaacaccaaatttcacaactttctacacacaagaaaagcaccttcataagtaccagaaatcaggtgagcaatcacactttctggttttaacttcatattgctgaaagaggcactgaagagagtaggaaatactgtcttaaattgccactgccactcctccttcatcccccagtagcagccacatgcacggagagagaatctgtttgatggggagagggagagcacagtgattgtgggacattgcattgaactcagtgctgctctgccacaggatacagcaaaaccaggctgaactcagccagcacgcacagagggagcatttagaccagccctaggcagaggggaatcacctgttccagtggtcagaaattgagtattagcaagcctcaacaccacaggctaaagtgctctggggttctaaataaacttgaaacacagtctaggccgtgaggacggcaactcctaggcaagtcctagtgctgtactgggccagtagaccttggtagggggcacaggacctagtgagacactagtcggggctgctaaggaagtgcttgtgccacccctccccaaaccccaggctgaagagctcatggcaacaaaagtgactcctttctgtttgaggagaggagagggaagagtaaagaggactttgtcttgcaacctggataccagctcagcaacagtaggatagggcactggtcagagtcatgaggccccctttccaggccctagctcctggatgacatttctagttatatcctgggccagaagggaatctgctggccttgaaaggaaggatccaggccaggcaagattcatcacctgctgactaaagcgtctttgggcccttaaaaaccagcagtgatgctgtgggctttgggtagaatgctataggctttgagtgagactcagatgtactggtttcaggtgagacccagcacattcccagctgtggcggctacagtgagagacttctgcttcagcaaagtggagggagaccagaagaaggaatatatatggaagttctcatatacatctatatatgtgaactccaaatcaatttttaaaaggcacagtcaacttgatagagaaattagcaaaatacttgaggagacacttcacaagaggatctgcaaatgtccaacaagcatatataaaggtgctcgacttcatttagtcatcagagaaaaacaaattgaaaccacaatgcaatgccattacatatccacaagaaaggctaaaattaaagacaagcatcaccaaatccaagcaaagatgtgaagcacccataaatctcacacattactttcgggaatatccattgctacaaccatttggaaaaacaatttggtcctatattctaaagctaaacatatacatactgtatgaccagcaattctcctagatataagcctaacagaaatgagtacaagtgcttaccaaaaaaaacatgtacaagatgatttatggcagcgctctgtatacagtcaaaagtcaatcaagattaagataaatacattttagtatagtcacataatggaatactgaagtgaacaaatcacaactacatgcaaccatatgggtgaatcccacaaacataatgttgaacaaaagaagccagacactaaaagagtatcctacttatatcaagttcagtaacaggaaagactcatctatgatagtacaagccagcatagttgttacccttgggaatgtggaggaagtgcctggaagagggaataaggcaagtttctgagatgatgaaaatcttttatttttctcctttaatatgggtgatggttacataggcctgttcccttcataaaaattcacaaagctatatatttaatatttttatagttttctgtataagctatatttcaataacaacccatccatttaaagaaaagtaatctttctccacgggctgaaatcggccagattgggtaattatggtcagctgttatatagtagcaactcttacccacaatgttttttattctgttgcctttttgccctgaatgataattcctgtcgctccatggatatatttagataatttaggatatttgttccaaatgatgattcatgaacccaagaaaggattaaagaaagagttaatatcactatgcttttgaaaatggaaagactgcaaatgtctcagtttaagtgtctttacgctattctaactcagataaagtggtatgtaaggaggccatatgccacagagcccagatgttcttgaaccagtaaacattcttcaatctgaatcaggtaagatctttagcttttcttaactgcttcaaaccttaaccacctcaactttacagtttatttaaccaagctccttagaaactaacagcaggcacagcaaaatctgtttttaaaggaataaacagggcaaaatgaaattgaacctttacattaaattaacattattttatccctaatgttgattgttgtttctgttaaataattatgatgaaaagaaaaagtgttgatgcaatcacaacttgacattttgttgttaagcctcctcattttgttaaacctcctcacatcatctaattgattattaggtggctgatttcattcacctggctatagtaggccacctgtaaagcaactgtgcctatcctacagcatgactcttcagtgctctgaaaagagaaaagggctgagaagttgaaactgggagtctgtcatgttcttgattctattggtcattctgttggatcttttagaaaatcattttacctctctgaccttcagattttcaatctgtaacttaataatagcccttggcagtgaaatgtcttgaatggtgacttttaacatagcagcagtcataaaaatataagagtataactatataaaagggtttctaggagcttactcttggggcaaattgttttgccacataatattttttaaacggacaggacagttatgaaagattctagagagtgttgtcatgttaactgatcaaatatatttgttaggagcatttttattaatcagtacacatgacttagcctgttttaaacaatgtcttcaaatcttaaatatttcatttaaggatattaaaagtgcttagtgatctggttggtattattcagcatggattaatttttttctaaaagcagacaatgtatataatttattgtggacatctaaagtctaatggcactgcagaggtgatggtgaattgttaacccttctcaatagtttatgaacaggatgaaaaactagaggctatggattcatatttgtctatatgatgccacacacacacacacacacacacacacacatttaagtgtgtattaagggcaggtagtaaagagaccaaaaaatgcttttaatgttctaaattagactgataaaaatccgtagacatatgggcctctgtcatgatcaaataaaaagagttcagatttggagatggaagtagaggttcaagtcccttagacttactagctaaataactgtgaacatatcatttaacctccattcacctcagcaggttcattttgaaaaatagaacaataatgcttaagagcttactgtgactattaagtatgataataaatgttaaaatacgtataaattgcaaagtacctacacatttaagatattattgagataacctttgagttttcacattcaaatataatgtcatttaagctcatagaatagttactctttgattcttgtaagtgaattacaggagatcagcaggaattatttagctcagatagtaatgagaaagaattataaagtgattcggggccgggcgcggtggctcacacctgtaatcccagcactttgggaggccgagacgggcagatcatgaggtcaagagattgagaccatcctggccaacacagtgtaaccccgtctctactaaaagtacaaaaattagccaggcgtggtggcgggcgcctgttgtcccagctacttgggaggctgaggcaggagaatcacttgaacctgggaggctgaggttgcagtgagtggagattgtgccactgccctccagcctggtgacagagcgagactccatcccaaaaacaacaacaacaacaacaaaaatgattcggagtcagaactgtgttgaagacctagctttatctcttatttgttttgtgaactaaaacaagagattaaattctctgaatgtcagttttcttttctgtaaaattggaatgatatgccttatagagtgttgtaaaacttcaatgagactctgtaatcgctacacacagggcttattggctcttaggattaagatttattttgtatgccagacatagtcctagatgctgtggatacataggaaaagacgtgagtcttgccttcaaatccataaacgattgtgggggtaatcacatattaagacataatgtcaataaaacatgataattcccatgatataggtatgcccaaggttcatggagtagtagtagaatccgaaaagattttcacaggagctggtcctaaaccgagggttgacaaatgagttagatgtgtgtcagttgcaaggcagattctgtattagttttctagaactgccgtaacagattgtcataaacttggtgactttaaacaataaaaatgtattctctctcagtcctggaagccaaaatcaagatgtcaacagggttggtttcttttggaggctctgagggagaaaccatcccatgcctctctcttagctgttggtggttgctgggcatccttggtgttccctagcttatagttacatcactgcagtttctgcctcagtcctcacatgaccttcttccctgtatgttttcacatggccttcttataaagatagcagtcattgggttagacccaccctaatccaatacgacctcattttaactaattatatttgtaaaggacctctttccaagtaaggtcacattttgggtggacatgaattttggagggacactattcaacccagtacagggactctctggttcccccaaattaagttctatttcatgtgcaaaatacatttgccccatttcaacatcctccgaagtctcttaacccattccagcattaaatctaaatccaaattctcatctaaaaattcaaaaagtcccaaatctcatcatctaaaccaggtataggtaagactgtgagtatgatctatcctggggcaaaacccctctccatcggtggatatgtgaaactagtaaacaaattatctgctttcaaaatacaatgatgacagaggcataggtttagacattctcattccaaaagggagcaaatgaaaggaataaagggatcactggttccaagcaaatctgaaatcaagcagagaaagttccattaggtttcaaggcttgggaataatcctctcatgatattctatcttgtgggcctttgttggggcatccccaccctctatggcctcttcatccgtggctccacccttagagtcattcctcctccattttctctcatctgtgtccctttcagtccaagcctagcagtgcttgttggtataaaattctcaaaaactgtgttgattgctcatgcaattcatgggagtctgtgccattatgcaagaaggccctccacagatcttttctagataatctcttgtctattgctggcttctgctgagattggttattagatctgttaaccacacacctaatctattcaatgaaatgtccagctacaacctttgtgttctctccagagcatgttttctcatcttttgctatccaaatagactgagaatttcccaaatcataaagtgctggtttgtttttgcttaacagtttttgcctcaatttatctcttccctctcgcattttaccataagcagtaagaagaaagcaggccacacttctcatactttgctttgaaatctccttagctaagtatccagattcatcctttacatgtttcaccttccacacaacacaattgagttgaacacaactcatttctttataacaagcactgacttgcctccagtttccgataatatgttcttcattttcatatgagacctcatcagaggcaccgctaatgttcttatttctagaaacattctgttcatgacaatttatatattctttaagctgatagaagctttctctacagcttccctcattcctttttgaaccctcaccaaaatcacctttaacatttatatttctactaatattctttttaagtcatcaaggcttttcctatcatatgcttcataattctagcctccacccattacccaattccaaattccaaagccatttgcagactttttttttaggtattattaccccttacttggtatcaaaatgtgtgtcagtttcctagggccaccataaccaattaccacagactaggtggcttataccaacagaagtgtatggtttcacagttctggaggccagaagtctgaaatcaaggtgttggccatgcttccttggaaggttctaggaagaatcattgcctctttctacgttcgggtggttcctggcaagcctaggattctttggcttgtaattgtatcactcccatctctgccttcgtcatcacatgcacttcctcttccttcttatgtgtcttcatatggccttcttagaaggatacaagtcattggatttaaggctcatcctaacacaattgaacctcatcttaattaattatatctgcaaagactctatttccaagtgaggtcacattctgagattctggatggacaagaattttaaaggggacactattcaacccagtatgtgttcttacagacctctaattcttcctcatcttctcttttaggtgacaagacactaatattaagttgctatggtgatagtttatttatttgacctactatctgcattctatttcttttcaaaatgtgtttcttatatgttaaacctttattatgtcagactgtggcaacacctagagaaatctaaacattatgtttttgccaagatgaggtcagaaacagtaaaacattgtttttaagttattggattaatatgtctgcctgctactaactgtggttaaataataatctttgtttttattcatagttaattacatgctcaagttgaaaatatcaaaggttctttatctgattctgtgaattgatatttaatacatggtctgccatggttacctagcctgggatttgttactttaacacatcaatcaatggcaaagtcaatgtgtaagctgctagtgatttgggaagcatctttgtattcaatagtcttgtaccttgtttgtgattgaaggtcattctttaagaaaagaatgatatctaagactgtaaattcattgtactttctaagctcttgagagtagagatttgcaacatcaatatatagccaggctttacccattcgggccactaagactgatactcatagttttaattattttcacttgatgaagctaattccaggaatactattctttactttcttggctcttagaagatatgtctattttatcatttggaaacttaggaaacaatatccttttggtttttgtgcaggcttttttctcatcatatacttgcaatattttacttatcttaccttcatagtaatccacatactagggatattatatttagaagcttcatgtcccactacttattaactatactggagtgttatttcttgaggtttattttgaaaatatgatccaagctcctatttcatgtgggtttgttgttggctaaaaaaaaatcctcttcagcaccccatttcccccaaaagatatcatgtcctaatctctgggacctgtgaatgttaccttacttggtaaaaggacctttgcacatgtgattaggttaaagaccttgagatgggagattacactggattattgggatagaccctcaatgcaatcaccagtgtccttatgaggaagagataggggaagatttgaaaacagacagaaaagaaaaaggcaatatgatagtagatgcagagatttgagccgtttaaacacaaactgatttctaatccctggcctccacaattgtgagaaaatccatttctgttgttttaagccaccaaatttgtgtaatctgttacagcagcctcaggaaaataatacaggtacgtaacattttcccttggaaaatatgagatacaccatactcctaacaaaaatgtaattggctgctggatttatatatagtagttatgtttctcagtagttctatgcagaaaatgcatcctctgagttgatactgggtttcgagtaacattcctccactttgtccttaactgaaatacttaacctgtcaaattaattctgaacttccccatagaatagatttttaaattgggagactatttcagtgatgtcttttataaagaggcacatcttttcctacctaaatagtgtatttcagatttgccccctctgtaaacattcatatttctttataaagcctcaacttctgttcagttttcatttcacattataaattacagattaaaccaaagcttccctcctttatgggtgcaaaattgatggtataagtaactgttctctcaaatggctaattatatttctagttgcctacttgaaggtctaattagccaattgcatatgcttttgtgggggcaaggagataattggcatcctcaagcaggtaattagaaaagcaattattagtgcccacggctaattacaagaatgaaaattgtccccaccaaaatggtaccagtgtctactgggcagaaaaccagtccctggaaagtgacaggaaacttaatccatttggcagtgttagaatggcaggcagtaaaacaaatcatcaactagacctacataatctataagcaacctcctgtgagagggctgtcagaagcctttctaactgtggcaaagggctgcagttggggcagttgccctattgccaataataacctgcacatgaacttgtatccctgtcaggagcactgtgatcttcaaagttctttcattcctagaaataacgtattatgaaatccattctcgagtggcgattttttatgatgttgtgttatcacacacgttataaaataaaggattctgtggggaaagccacttgtgtttagttgcttttcaactgcatctgaccagttctttaagtaacagaacttcagttaaatgtttcagtgaattcgtcttttgcagaaagcttcctgtggttagcaggttttggtgttgaagtccctgcaggttttatgcccaattaagcctctgattgggctctttgttctttattacccaagtatttatcccatgtaaatgagaaagggtagaaataggcaaatttgttttatctgacagcaagtcaacaatttagctctcaagtaacaagaaaataaaacttgttgagaaagttggtactgtatctgaaaaatttaagtctgctgtcaagaaaaatgaaaaagcctgaatcgctgcatctcctgacacatttcaaaatggggatacatagcacaaattatagtgtgcttgatggtgctgttgataatagcaccctgcgctcctcccagggcaccgagcactactgctgaaagggctcaactgcgggggttgtgcgcagatagttgcctgggagagctaaggactgttaggtcagagtttccaagaatagagaaaatacgccagaagaattaatgatttaactgggaaaatgcctttgtcattttttcctattttaaaatttctttgccctactctgtattttcccatcattcctcctgcctagtcttagtcatttactttaatcaggaccccctgcttcctacgccagggcaaaatgtctagaactatgggaaaattttgcctcgaagtaaaagtcaaaacaaatgcaaatctgctattagagttgagcagtttaaatgctccagtacaattgaggattaaattctggaaaagggtatccaacataaatacacaaccaagaggttattttttttaattagccatgattgaaggatagtgaagaagaagattaaaggcattaattatagaagagacaaagaataagcagacttttcttaaaatgtagtataaaacagttttgttagccagagaataaagatatttgtattccattaaatattctatgcttttatttttttcagacacattttcttgtacatttgtgtatttcatgtgtttcccaaatcaattttgagatcatagaatgcatggtctgtcattgtctctccagagcaggacaatctgacaagtggtcacccagcctctacccagtggtggcccccaaagcagccttgttagtttaaaaagaaaaaaaaaaaaaaactcttattatttgaaagagccttctttccttgaattgacttgcttattctaacttccacccacagtttctgttccccagaactgccacagggaggttctgaccctgaataaatggcaacctctcagatatcaaaaggctcacgtactaaatctttcctccaaatccccaaggcctctacggcctttctgttacgattgaattttagctgatttaatatctgttcctaaacagtgaccaaacaataattcagttaagcttatatccaaccagaggatcattatgtaaatttgagtgagggtagagagagtgaaggaaaatgaaatattctgcctcatttacctttagaaacttgtaacttgacttaaaaaaaaaaaaaaacttttaaactgaatatattggtgtcagagagatctagaccagtatgtttttaaaaattccatgcctaaggtaatatttcatctgcttttctagctttattctcttttttctatcttctactacttttttaataagcttaaagtagaaagaattaaaaggcacctattttctttactcagtttcttacacatacttcaagcttcacatagatgttcgttagcattaaaaatgttcgggggtttttaaatgaacacattttctcttactctgccatctgccaaaccagtgcagttcctatatgatttatgtgagataacccagaagagtcagagacataaataaaaactaaaaatccatcagtggtaattagaatctgtctaatgacaatggtgatgtttggaagaatatattatacatgttcctgtctcaggactttttaatatccttctcttttttgctgaaaatcttttctcccccaggtccacatagcttacttccttacctgcttcaagtctttactcaaatgtcaccttttcagtgaggccttgcagagccagaccctataaaattgtgcttcccccttcctcatgccaacatacttctaaccaccaacatttcctgccttatttttctccataacatccatcataatcttacctatgctttttctcattattatttgtgaaatatatcatgtgtacaggagagtgtacaaaatacatatgcacagtttagaacaaacacctgggtaagcaaacacctgtctaatcaccacccaggttaagaaataagaagctccctgggtgttcggaaaggtaaccactgtttcaacttttatgatagtcattcccatatgttttcttattattttatcaattatgtatatttgtgaataataatacagactttagtcatttattctagttaaaacaacagactaagatatctggcactctttgtatatagatgagttcctagacctattccagaatactccaaaacttattctcagcccaagcaacttgactcttccttcaccagctctcttaactctgtctatttcacccccaaccttccatctctttccaacctttcttccctagtttggcataccactactagatgtttagattcttctccaattctcttaacaggacagtcttcacttttgatatgagtcagaatcaactgaccaaggtaatcaaattttaatgaaaataggtaatttctttcattcctgaaacaaatttaaatagttatagagtttctgctatttgttacctattctagtaacagaaaacctcatgcttatctggacagccaaactttttgttctctggtacaatcctcagagtgactttgctttgcttacagttatcccatgtacaatttccatttagatttattccaaagatttcagcaagcatactgcttcacagatgatctcactttgttttgataatgtgctcaatcatttcatatacaatcaaaatgagtaatcagaggttatgcaaatgaaactttatcatcattgggactgctgcctatttgcaagtatccttcatcctcatctagttgaagttagctattattctattctacagaattttcagtggaacaatgtccacctttcttttgtacgctacagagtccagagaactgtactcattttctttttatgttgttagaactagatgtatcattcagctataatctgagttctacaatagctgtaatcactgtgtcactggcccctgaaatgaattcttagattgggcaatcactacactatcaacatatattgggtgtagcatctaaatcttctgttgagaatattgccgttttacttatctaaaacagtatgcagtaagtgtagcagtatatatctaaattaacttcttttgtagcattttatcagtgttctgccttttctctacattggctgcattttaccagaaacaaaagttgtggagcagtaaattatccatagatagtctagaagctcttttgataaaggatattcaaaatgttatatgaaaaaaatataagtttttctttagttttttcatttattagcttcagcatttttcatttatttcttcattcaaagaacaggtttttaactgatagctaaaattattatatcctctgctcaatacggttaagttcaaataggcaaaaatatacacagaactctacttctaaaaatataactgaaatatctattttcagtttgaaaaaaaaatcattctttctagagggtacctagcttcagtggcagactgatccagttctttgagagacatgttattgccagatatttagaataagtagtatttggaagaatacaaatatacaaatgattttttccatataagtagtaaaactttaaggagatgctttaaagaagaggcttaaacattttttcatcactaccacaaaataataatttcaccatttttaagggttcggcactgaactgattatgaaaagaaagtcttgttgcaagacttcaatgaaaataaaatatagtatttttaataattgtatggttagtcattatctgtgccctactgatttttggtcataaggttatatttgaagaaatgtcttcttttatatattcaacttcaactcaatcatgtaataaacttatctggcatgtgaagaattttatgtagtctctcatcatagaaaatgatggtaggttgcccatctggcaaaggttgtaagttcagatatgctgatgattattatctgtgttaaagcagcctcaacactttccaaaatatattcatataatagtagctcattatctatattaaaccacaataaagttaatattaataccatggattttataaaataactttgaacgaagctgaaagcttcatttagtttaataataacgatgcttgaggaccactttggttttaataaaaacatggaaagtagcagatgagaaagaaccataaagatgccagtcgaatagctgtaataccaattagttggcaattgattcattcatcaaatatttattgactacccactatatttatgtaccatcacaccttggaccaatagaaactgaattaagttttaaaactacgatgaataagggtgcaaatgaggaatgactgattgataatcccaatgagtgtgggatttttctttgtggtgggtgatgaaaatgttctataattacatgacaacaatggttgcacaattctgtgattatactaaaaatcaatgaactatgtgcatccactctaaacatgttgattttatggtatgtgaattaaatctcagtacagctacttagaaaaacaaagctttattgatggaagacaacaatgtcataatgatattgatcataaagttattggctctcagccagtgttgaacaagtagacaagtgtgcatcaaacggtttatgagacaatcctaaagaagtcggactatttggatttgggattaacatttgctctactttgcatgcacaagaaaactcaggccttgtgacacagtatgcatgcctgtttttaaacaatcacaaatttacaaaaaagtatttacaagtatatataaagaatttttttcctcataccatttcagagtaatttgccacctgacacccttttatctcctaatactttgatgtatatctcctaaaaaaggaacattttccacataaccacaatgtagccatcaaaatggagaaattaacactgatgtacgactaccacctaatcctgactccattcaagttacagcaatttttccatttacagcaaaattatagcaaaagaatctagtttagaatcatgcgttgcatttagtttcctcagtatacaacagtttcacagtctttccttgactttcatgggcttgataattttgaataattattttataatggattttagaatgtccctcaatttggatttgttcagtgtttcctcatgattacatccaggtaatgtaatctttagtggtgatattcacttcagcaaaagtgattctatattcttttcattgcatcctattgggatgtgcacaatgtcatcttgtgcattgctgatgatgtttgctttaatcatttgcataaggtagtgttttcttcaatataaaattattattttcctttgtacaattaataagttctttatgggaaacactattaaactatgtaaacctcccattccttatcaaactttcaatttaatatttccttatttatatgacaccttcctattttattcactgaataataatctgttactatcattattttgatgctcaaattgtcccagatctgagaggcccctttaagatggcttctgtgtccttttgaaaagtctctatattctttgagcatttctttactttctggcacaagatattccagtctcatcttgtactttctatgcctcagtgatttctccagaaagtcctggtttcttttagtggaaaatggtatttagaagccacaatctgacattaggtgtgctcattgctattgaggtattgctgcttccaggcctctctgtagacagagctggaaaacatagctatgtatatatacatttacatgtatatttatttctctgtctatatactgaacaccatgagtttatataaatggctaaaattctgatccagaatccaaggttcatttatctgttcccatatttataactcctttacctaattaggtgatgaacccggtttccattatccttaatgtattgagtcaaaaataaagcctccttttatgtgaccagtctcctggtctcagctttcctcccatccccagtgcagattccagtctcccatgtattagtccgttctcacactgctataaagacatacctgagactgcgtaatttataaagaaaagaagtttaattggctcatggttctgtgtgctatacaggcttctgcttctggggagacctcaggaaacttacaatcatggtggaaggctaaggggaagcaagtgcatcattacatggctggcaggagagggagagagacagcaaaagaggaggtgctaaatgctttgaaacaaccagatctcttgcaaactctatcatgagacagcactagagggatggtgcgaagtgctaaaccactggaaaccacccccatgatccaatcacctcccaccaggccccaccttcaacactcgggatcacaattcaacgtgagatttgggtggggacacagagccaaaccatatcatcccccattcaatctccaaaacccatgctgggctggcttctgccccacacggatccctccttatcctgctaatgcccttgtgctgagtgccagatcactcccacatctagcttccctcctcactctgcctgggcacctgaactccaaatccctgtgcagagttgtcccctgaatgcacacacatctcacctcactcaggctttggatccccacatgggccacaacatgctgcactctgctggctctcagacacttcatgccaggctgcctctctgtggagatgccgtcatcaccctgcttgggacagctttaaaacaggcaactgccatatgcggttgccttttccaccccactcatgttctgatgccacgtctgccctccttcacatgtacctcctcaccccaatggggctctgatgcgtgttctggcacaccatggtttccccttcccacctaatctggacacctaccttgctctgctgcccctaatggctttaggactaaattgttgaaacaggtaagcaaaaggaagcaaaagggaaggggaaggggaaaagctcatgcaatattttaacttaacacatctttctcacccactggactgaagttcatggccgaaggaaccacattttttccatctttttattctcagttcttaacaaagtatctgattcatagaggtaggtagcagtgcaataaatgcttgttaaattaacctcattcaagtggaaagctgagaacttaagcaattccagtctttggctcttatcagtgatctcagtcaaaccctttgagcattattttcgaaaggaaagtaaatcataagcagtttggccagttgtcctccaaagaggatctttctgaaaaaatgtaacaaaatgaagccttttcatgggggctaacccttctatatacaatttgctaacaatataaattaaatctattgatttattttgaaatcataaacttaaaaagagcaatgttcattagatgtagagcttttattcttaattagtatcaaaaatcattgatcagaattatgccttctttcttccattttcataatataggcaagtgaattagtttccatatagtttcaaccttatagctcctccaagaaatgtaataaacaaaaagataattaaatgatatttggactgaagcattacataggaataacaaacataaaggctttattctaaaatatagggaccttgacttttagttcctgttaatggcaggaacaagcttttatttgtgtcttttctgggaagtttgttcatttattcaaaatgtagttattagacaactcaggccagcaacataatttgtggggcccagtacaaaatgaaaatgcagggcctcttgttcaaaaagtaggaaaaataggcctttaaaagtcctaaaatatgacaccttttcctttcttccgtggtctctctcctggcctttcgaatagtgttttttaatttgcaatttaattttacactcaggcactgggatactcaccaagcaggtatcaacttttataggcacctgaaggctcacctggggcagaaggaagggctggggtgcaggcatccacagcccaccaactgcaaggcttcttctgccaatttttggactgacactggggatattagaatgaacaaaacagacaaaaagtccctgcatcatggaatgtacatgtcagcagaagactcagttaaaaaaaaaattgtatgtgtgcacgtgtgtgtagtatctgttaggtagtgataaaccctttgacaatcaataaacaaagcaggaaagtggggtttggagtactcagtgtagtggatagaaatgggctccaatttgaagtaggttaggaaagccttcactaagaagatgacattcaagcaaagatctgggagaagtacaggagccagccatagggctatctgggctgagatgttgcaggcagtggcaggagcaaatgcaaattcttctcagtcaatgttgcaaatacttcagtgagacagtctaattttctcagagacctttttttttctttttttgagacggagtctcgctctgttgcccaggctgcagtgcagtggcacgatctccgctcactgcaagctctgcctcccgggttcacgccattctcctgcctcagcctcctgagtagctgggtctacaggcacctgccaccacgcccggctaattttttgtatttttcgtagagacggggtttcaccgtgttagccaggatggtctcgatctcctgaccttgtgatccgcccacctcggcctccccaagtgctgggattacaggcaggagccaccgcgcccagcctctcagagacttctttttactccacaccccacctacctttccccacatcactaatcttgtttctggaatttgttccaccttctcttttccaaatttagttagcctaggtgagattcctgctctctcacctgttacaggaggcttctaacttcctgcctcaaagctctctgctccccataccactgcctgttgccctcagcactgctggagctcaagtctcaaacataactgactgtgtgttcttactcagaagacccattgtgtggctttcatgcaccataccaaaatgcagaagtatgggaccctatgttatgttcagaaatgccataaaatgatctgccccatatgctgactaaactggttttgtcctgttacagaccatcacctgctcatctacacctccatgcctttgctcatcctggaggatatttgttcagtctcagaacttgagggctaacttttcattccaatttcaactccaatggagttcttcttgaaatgtttcttgatctctccaattagaataaactacttacttggtttcagttttacttaaatatctctctgtccaccaagtaatgaggttgctttttttttcttttttttcttttttcttttttttttttttgagtcggagcctcgctctgttgaccaagctggagtgcagtggcgcgatctcagctcaccacaacctccgcttcctgggctcaagtgattctcctgcctcagcctccccagtagctgggacgacaggcacgtgccaccatgcctggctaattttttaatttttagcagagatgggatttcactatgttggccgggctggtcttgaactcctgacctcgtgttccgcccacctcagccttccaaagtactgggattacaggcgtgagacaccagtaataagctttctttacgtcggagatcctgtcttatttatctttacatttataatacctgtctctttgctttgcacacaatatggacttaatacatgcttgttgaatttaacgttattaatgcaactcatattattaattgtaatggtagtaaattctacaataacacacctggcaataatgcaaattagaatagcttgaattgaaacatggaatgattggaaagcagctttttctcctctacctgattccttttctcaggaaggagaagggaacatagaggcctctccctcatggggatgctggacagggaaaaatcagacaatcctatttcaggaaacagagaggtgggggttagttcccagtattctcccagcccattctctctggatcaggccaacaaaacattcaccaattaacgaagagattcctggaatcacagttgctctcccagaagtcccagccaggccccagaattctgcccatcaatttttatgttagagcagtcaccactaggtggtgccgaacttcagcccagggtaggtgaaatttgcatcaaatagactcagaacttccagatgtccagttgcacaggctcaccttggccatttagctaatctcataataacacaaccctacattttacacagctgaatttctggggcactacttattgcattatggcagttttgttgtatcattttctaaaaatctttcaatatcagatactctgccagccactttacaggctttatctctaatgctcacagtaacctgtatggtaatgggtactgatacttttcttcttttagtaaagaatctgagctgggcatggtggctcgcacctataatcccagcactttgggaggccgaggcgggtggatcacccgaggtcaggagttcaagaccagcctgaccaacatggagaaaccctgtctctactaaaaatacaaaattagctggacgtggtggtgcgtgcctgtaatcccatctactcaggaagctgaggcaggagaatcgcttgaaccccacgagatggaggttgaagttgccaagatggctccattgcactccagactgggcaacaagagcaaaactccatctcaaaaaaaaaaaaaagaagaagaatctgatgctaagaaaagaaatgtctcttgcccaagagctgtgccttgtacagctaagtgacaggtgacagacctaagaattacattcaagcctgtctcactctaatgccatacttgtcatatttctgctatacttcaatttaatgatcaaagaaaggaaggaaagagacagtggagaagaaaagtagggaaagaaacagaaagagaaggggagaaagatatgtttgacagaaaagtaaatgaagtatgttaccatctgtttttttcaaccccagaggtctgattcccccgcaggaaagagttgcttctagcctgtcctttatctctgcacctgccctgcttatctcctgcaccagaggctcctaccatgaccattaatggactgagtttttgtgtccctacgaaatgcatagcttgaagccctaacccccaatgtgatggtattaagaagtggggcttcaggaaggtaattaggtttagatgaggtcatgagggtgagttttctctctctctttctgtcatgtgaggacacagcaagaaggcagccatctgcaagccaggaggagagtcatcaccagaacctagccacacaggttccctgatctaggacttcccagcctccggaactacaagaaataaatgtctgttggttaagccaccccagtctatgacactgtgttgtagcagtcagagcaggtgaaaactgtaacttgttattctctaaggaaaatacaggtcttcttctcaggcctgtcttcagaaacaggttcacatccccatcttccagtcattgaactaaatggaaaagtttttgtcttcctagtcattgtctgcacctaaacacaggcttgcccatctgtagtcctagtctgttccttttctttggtgaggataacccttcctgtcttgctttaacaccctgtattttccgttcattagtgactcagacctctgataatggtatactagttaaccccctgtctcgtctgactttaaatgattgcctgttttgaccttgaggaaatatgagtccactaggaactacaatctttatggccacttgaaaatctttattccacttaaggtggaatagggtaccttgccacagaggaaacaagtaaggagagaaagagagtaaagatcagtgagaggaagagaaaactaaaactactagtataaaaagttctgaaatttcagcaaattattttgcttccaactgtacttaaccattctgccctttatttgcaataaaaatattggggtattattatctttgaaatgcagattatgtggttaaccattgttcactttctaaaccctgtaagtatttaacttgtggatggggaatattgtttgggactgtattggttgcaaaccaaaatgatctacactcacacagcttagtgtcaacattaacatgactttactttttagctgtctttgttaacatgactttactgtcctactgtcttcatcaacatgattttactattccaagaaactcttgccttggaagataaaaatagcaaatgattttcttgtccctttcagaaactttttgaaaattcatttaaaggaatattaaataattcaactttcacagttagcatcagatgaatgtttatgctccaaaattcattgtgaaaccttcagcttgtgtgtcttccaaacttaaattattatgtagtgtcttaaccaatgttaagacattagtgtcagcattactgacacacaatcaaatgctcccctatggaaaaacttgccttaaaaaaaaaagaaacacacacacacacacacacacacaaaacaaaaaaaaacagaatttctaccttccgccccccaccaccacacacacacacctaaattctcttaaatatcccgactttgccttcctcctcccagagactactaaggccatgtcaaggaagctgtctcccctatggtggtaaacaatgaactcagctctgtcatatgacaggctataaaaagctgattttgttgatattctgggaaagctaccattcagcaggcaagtgattgaagccatttcctctcaaacttatgaaagtaaactaaaggtctgattctgcccagggaggaagtttctccactctatcatatagaatccatatgtccatcatacttttatttgaaaagaagggatgctaactctcagaagcatgtcatagtaagcacagaagtggaaaaaaagaattgatcatttttgtgagggaaaacttaatgaaaaaattacaaaatcattataaatacaattcatttgaagttatgttttgagattacattattttctctctggcatttagacacctaaaattcactttaaaatatgttggtgaacaaatctcattctccagaagtacatttttaaaatggcaatatttcataataacagtataaaatgaaaataattgactatctcttgccttgtgggacttggcttttagtctaaatagatatgaaacaaaatgacattcatctatatgagacgtttgttaacttaaaagaaattaagtcagaagcctataaggctaatccataaatcagcaaatcagataaattagtaaaacttttccagaatattatccaggggctccttactcctttgcaatttgttacctgttttacatgtccttttaggaagggttcatttcccattgacaggcaaaaagaatatatgaaattagaattttcaacagcttgcaacatttgtgtcatttttgatttaacaattttagaagacttgttccaaaattacacctgaatttcattttctttgtagttttctaaaatgctgctactatcaggacataataaaagccacacagccagtactagaaatgctgtcatgtaaccactaagaccacactaaaaggcaaaatgctgcagctgaaagtatttttaatgacttgaaattgcttggaatgctttctagaagtaaaagggtgcagatttatttacctagtatacttacctaaattaatttggcaagattattttggttcaaatcctcattcaataaaatttatgttaatatttttaagtggtttttttcctgaaggatataatatattgcattaacacaaatttacaacagtcatgaaagtaaaaggtaaattaagccatttctgaaatatgaataaggactacatttttaaatagactacatttatgattttatgtgaccttgcagataaacatcactatgtaaactgttaatgagaacaaatagaatcacattctatttttagtttttcctgatgtatagtttccattagagatatggaggaaactttattcttgcataatttttgttttagaagtttgggtttttttgtgttttttttttaacattttaagcaaatgggctttttatatatctttttgattcggtacattccttactacagaatgaatcctagtgaaattctcactataggccatttttccatgtttttttcttttatggaaattttaaccatggttactaacatataaataaactcttttaactgcaaagtcagaatgggtatactttgttatgaacatattaacttattccagtttcatgtcttgtgtttttctgcactcattaacatctccttggtacttgggatcatggcctggccaatacgcataaagatgacgagatatctatggactacagtacatctgtttaataattagtaattgttatgcattgtaaatgaacgattttgactcataccactgacatttaattagtttttactatattccaggtacatatgagaatgtcacataattatcttctttaatttttacagtaactgttatcattacttcagaaaggaacaaaactccatttagagaggttaaatagaaggtccaaaacatgtagcaagtaaaaagtatccagaacttagatccaggtttgtatactactccctaattggggctcttaactactttgatgcattgccttttaaacttactttcttgattatctatttgactaacatctccccaggacacacaaaatacttgaattcatgctattatggcctgaatgtttgtgtccctttacagtgtatatgttgaaatcctaaccctcaatgtgatggcattaggaatcagggcctctgggaggtggttaggtcatgaggttggggccctcataaatggcattagtgcccttactaatagagacagagacctggctcctgctctttgctctttgccacgtgagggtacaatgagaagacagccatgtgcaaagtaggatgagtgcccttgcaagacactgaacctactggtgccttgatcttggtctcttcagcctctaaaactgtgaaaaataaacgtttgttgtttaagccgcccagtttatgctaaattgttatgatagcctgaactgacggagacacatgcgtaccacaaacaacaaaggctcaaggatccttaaaataaaaaccaagactttcagtgggttgtaacatcacgtagtggaggtaggtttcctctcctctatacctctcccaagtaggaaacatattaagatcacaggggagttaattggaactattatttcatatgtaaagaatgtattctttataacttcttgggaatatatcttaatttcttttaaagaagattagtctaagttatagtttagtctatagttttgtaggttagtctaacaacattttcgttaagtctaaagaataatttgcaaactatgtgtatgtgctacatttgtgtattgagtgggtgaagatcgagttcagcacagcatgcctcttaggtaaatatgtaaaattctaggagttatttttcaaggggtacaattctacacccaaacattcccctcctaattctacctcctaatcgtagaagaagcagccccttggttatttagcccaagaatccaatgtgacttatctgtaatcctattagtccattctattcccttgatattgggaagttttgcctgtcccaaaagaggccattcggaggttattcttggatgattcactcacttgtgaaagcaaattgtgttggcttcaagatgctgcatttttttgtaaacaatgccatgacttttacatttctttacatcttggagctacccacttctgcaggtccattctctctctgtcaccatttaaaattatgtaaggtaagttttcataaacccgtaaaataatggttacataaattggaacttcctaccactcatatcttagttgtattaaatcaaacatttactactatttccatctgtttcactccatgacagcatcacctacttgactctgttatactaagagttcagtgagaagagcatcagggagcttagttctatgtagtatcacagaaccaaaaagcaccttaaacttgtcagggttctgtttcttcagctgtagaagaaaccagggttagggttgggggttatggggaagataatacaagtacaggtaggcagcctgtgtgactaaaagttgtatctggtatgtttgtcacttagggacttttatggacctagattctaaaaatcatcccaataataaccttaaatcatgtcagaaaactctacaatggaatagatttttgcattcagaaattacgtgcattttccccagcatggtatccacttacctaacactttatgctacataaaacgataaattatctagtgtgatctaaagccatcagaaacatttaaaagttttatagtacagtattttaaagtttactaaccattatataaaattaataagatagtttatacagtctcttgctttattgattgtgggtaataacctgtagatgggaatatagtggaataatgtgcctaactgcctttaaaagaacttacttaaacttcagtaatttatttctgtgtttcttggattccttttacttctgaagtcttagtgaggaacggtcagatattgagttgctgtattcactaaatattttgtggagaatttctttaaggaaagatgtggattttaatgcataaattttttagacagactattgaagttgaaatttcatttcaagaggcagtcagctttgtttaactctatatttttagtatccaaagttactgagccagactttgctttaattaattactataggatgtgaggcagttccagtgctgctttttctattaacttgcaatttcctgtaggaaattaataaaatgaaagagggggtggccggcaagaataaatatatgctacagttgcaagtcactaaaattcatcagaataaattaaactgcacaggtttcctttttttataattctataaagcttctcaattcttaaggcaaatttgacaaagaaacagggccatctaaaaatgatcaactttcatataatatacattaattaattgattagaatatgaaatttgtcagatcagtgttgtttaatggttaagaaggtaaattctagaaacagactgcctgagtttaaaatctggctctgccattactagcatgagactttgaacaatttacttaacctgctgtacctctttatgtttaagatgcaaattataataacacttatagggttcgtatgaggattaaattagttaatatgcatagtacctggtatatacaaagtactacacaggcattaacagcaattagcatctgttttttcatcagtattaacatttaagaaaaatcatcttactttagctatccctttctgcaacctctggagtcaaatcttaaggtgacaaatttaagtttttaaaatatttgcaaattttgctttgtttttctgagtcctttttaagtgagttaccaggaactccaatgaatgcatgtcgttgtactcaggtacttttttttttttttttctttgagatggagtctcgctctgttgcccaggctggagtgcagtggtgtagtggcatgatctcagctcactgcaaactctgccttctgggttcaagtgattctcatacctcagcctcccgagtagctgggattacaagcgtgtgtcaccacacctggctaatttttgtaattgtagcagagacggatcttcatcatgttggccaggctgttctcaaactcctggcctcaagcagtccatctgcctcagcccctaaagtgctgggattataggtgtgagcaatttcacttggcctactcaatatacttttaagtgaatactatgggtaccaaattcaagtgtctgataattttaccccatgagtaaaaggatttctcttgctgagatttcagaaattgttgagaaaatatttggaagaatgttagcaattgaccaggatataaaaagaaacacagaaattactcgcatttagatctgcacctcaaccacattgaaagggtggcaggattttcagaatgtggttgccttttcattgtcatgcttatgttcattctacaatcaatatgtattgccactgaaataaagatataatacaagatagaattaaggcctactgctttgactctattgtttatctagttaatagcgttaacaaattttagttctagcttcctttgaactgcatgtaaatgctgcctagtcaatgacatacctgaaatagcttcttgttctttattatgtgtttatgtgctcatctgagcgtgtcttgttactaggactgccttataaaagtcggttttaatttcccgagttaattaaaggtttctcttacaattacagcctccctagttttcaggggtttgttctttttgtgtgtatgtgaagtggggaagaaggtagttggaagagtactaccttttatcattccatcttatatgatttatcttcgctgtgtgtattattcacctattatttttcattaagtaacaataagtgattgaaacaaatgttaataaaatgattaaaatatatttagtaacaaatttatctgtttttccccctttctagtactggtttaagtggactggagtgagaaagacattattcgaaagatgttgcaaatttatcgtgttttcatgttggaaatgacataaatgactttgtccaaatgatgtctttttcagtgtagaatacttaaaccagtgctaggaagaaagttttttattgtaagaaagtagatttctttttattataagtaaataaaatatcctgattatggatatttcataattcgttcattcatcagtttatggacttttggcttgtttctagtttggagctattatgaataaaagctgctatgagcatgtgtttataggtcttcttgtagacacatgatttcatttctcttacgtaaaagtccaggaatagtactgctagattgtatggctaggtatatgtgcaactttatgagaaactgccaaactgttctcaaaggggcggcaccgctatgcattcccactagcaatgtgcaaaattttcagttgctccacacaccattaattcttgaactagtcagcatttttaatgttagtcattctattgggtaccttatggtgatttgtttttccatttccctcatgacttccgaggttgagcatcttttcatttgcttattgaccactgatataactttggcgatgtgtctgttaattttaatgatgttcagtttattgactttttctccttttatgaatcatgctttgatgtcaaactgaataattttttgcctaactcaaggtaacaaggattttcttatgcttccttctaggagttttattgcttttattattatatttaggtctgtattgtattttggcacatgttttgtttgtttgtttttcttaatgttgtatgtgataagggctgaaggtttttttcataagaataccgaattgttccagcatttattttgccaccattggattaccttaaccactttgttgcaaatcaatcaactatatatgtatgattctatttgttgacttcattctgtttcattgataaataggtctatcctaacaccaatcccacaatgtcttggttattgtgactatattaggtcttaaagtagtgtgaagcctccaatttgtacttcttttccaaatttgttttggctattctagatcctctgcatttcccgtataaattttagaatcaactttttcaatttatcaaaaaaatcagattatgaatgagattgggttgaatctatggaccaatatagggggaattgatatctgaagtcttgtgtctcttctaagctacaagttaaataatattacctcttttatttaggttttctttaacttctgtcagtaatggatttttagtgaaatattttaataaatttgtacctaaatttttgatactactataaatggtagcttttttcattttgatttccaattgtttgttaccattgaatactgaaatgcaattaatttttgtggatttatatttttatcttgtgacattgcaacactcaagttattaattgtagtagcttttttgtagattccttagggtttcctatgaaacaatattgtcatcttcaaataaacacaattttagttcttcctttttcatctgtatgcctattatttcttttacttgccttgttgcactggctaggttgtctagtacactgtggaattgaaacgattcaaacaaatacccctacattatttcatatattagggggaaacattcagtcttttaccattaagtatgatgttaacttcaggttttgtaagatggtctttatcagagtttaggaaattttctattcttagtttgctgagaaattttttttaggaatggatattgacttttaacaatatttttcttattttttgagaaaatcttgtggattttacttagtatagtttgttattatggtaaattaaattgatttgtttttccaatgtcaaattgacattgcctttttaggattaagctcacttgtcatgacatatgttttttgtgcatggctagattcaatttgccaatttgtaaaaggatttttactgagatgttgataaagtatactagtcagtaatttttattacttgccatgtcttttgcaactttaatatcagaataatgctggtttcatgaaatgactggggacatgtttcctcctcatctgttttctggagagtttgcatagaattgatattatgtcgtcctcaaatgtatttgatagaaattgcccactgaagctgcctagtccttggggttttctgtggaatagttttaatgacaaattcttttatttttccataaaagaacttgatggtttttatttgacctactaaccttcggccagggtaattttgacagtgtctgtaagataataaagtggcaattatagtagtaagtttgatttaaaacacctttaacataaaaaagaatacttgttaattcttggaagtaaaaccacaagtgtttatacatgtgaatatatataatattctttaataaattctatatctttagtagatatatggctgttcaagttatatagttcttgagtgagttttggtatttttagattttccaggaatttattattttatctaagttgtcaaatttattggcagtctcttatcttctaaatattcccttattattttttaaaatgtctgtaggaactatagtgatgtcttctctttcattcttgatatatgttgtttctttttcttggtctgtctggctagagatttatcatatttattgatattgtctgagaaatagcttttgggctttatggattttttcctttgtttttctattttgcatgttattgatatttgtatctttattatttccttctctctctttaggtttaatttactattcgttagtgtcctaggagggaagcttggaacattgattagagacattttttctttcttagtataagcatttaatgctataaatttcccttcaagcatcctttagctgcattgcacaaattttgacttgttatattttcatttttattcaattcacaacttttttcaattttccttgtgactatttctttgatctttggcttatttagaagtgtgttgtttctaaatgtgtcacaattttccagatttttaaatttatttttagtttatttctattttggtcagagaatattactctatggtttttatcttttttaatttgttaaggtttgttttatggctgagagtatggtctgtatggtgaaggattcatttagatttgaattgaaggtgtattctgctcttgtatggagttcttgaattgtcagttagattagtttcattgataatgccattatgtgttccacatacttagttctatattcttactgattcttcctcagagaggagtgttaaaaatctccaactataattgtagtcttatttatttcttctgtatattctatcagtttttgcttcatgtattttgaagctctgttatctttaagcacatacacattcagctgtctactattagctagaagctgataggtcttcttgattaattgacttctttattattatataatgttatacattttcctggtactattccttgatctgaagtcgtctctttgtgcctttaatatagccactccagctttctttctttaattaaacatttttagatttcttttttattatacaggtaagaaacatttaattataaaaatatgtgaaaatttgaaaatactgatagtcaaaaataggaaggtaaaatcagctgtaagctcactacccaaaagtaatcactgttaacaactttgtgtatatacctatttttaaaagttttatttttatggtaaaatacacatgacataaaatttactatcttcattcttttttagtatacagttcagtggtattaaatacattcataatgttgcacatccatcactccagctttcttttgtgtttgcatgaaatttctctacctttttatttttaatctgtgttatatatttatatttaaaaataggtttcgtatgggcaactatagttggcttttacttttgtatccaaaatgacaatctctaccttttaattcatctatttagaccatttgcatttagtgtaattatcagtatggttgggataaaatctattatattattatttgtttacaaggttcttgtttggatcttgttgtcctatccctgtagtctcatacatatttcacacttcttttcttctactctacatgtagccttcataagcttattctaataccttcaaagggccaattttttataccccactgatatttttacaagctattctctgcctacttaagcagacggagttttgttcttgttgcccaagctggagtgcaatggcacgatctcggctcactgcagtctctgcctcctgggttcaagcaattctcctgcctcagcctcccaagcagctgggattacaggtgcacaccaccacacccagctaattttttgcatttttagtagaaacggggtttcaccatgctagccaggctgcctcaaactcctgacctctgttgatccacccacctcgacctcccaaagtgctgggattaggggcatgaaccaccgtgcctggcctttcccctttttctcaaccacacttaacaaattattgctcatccttcagatctcagtaaaattgtattcctctaagaagcttttcttatatttcaagtctagagtaggtgcctttccctactttcgcttcactgtccctagaattaatagaattaatatcaatattaattatttaatttaaactgtgaatggaagaaagtatgctagagagtgaatatggatgtcttctcttcctttataaaaggagaattccctagccagattgccatgacagcaatccattctttcacactgttagaatgtcattttgaagtgcctctgtggggttcttttgcccaccctgcctgggatcatctaaatgacgagttaataggtacagcacaacaacatggcacatgtatacatatgtaacaaacctgcacgttgtgcacatgtaacctaaaacttaaagtataataataattaaattaaattaaatttttaaaaaatgagagaggtccctgacatccctgcagggatatgggttattatgtatagtctgtccaactataatgttgcatttttgtttcattgtttcttagagattaataccccaaagaggggtctatttcctgtaatttctgtatttatcaagctgaaaaagcatgtccataagtttagaaaactgaagctgagatgatgaaaatactgtgctgttgtttttcactaatagttgcctgattatatcactgaaagaatatcaaaaactgattttatgctattgcagtaagatagctgctggttgtacttggtatccttatgaaacaacattcttttggcattagattatcactaacatttaaataaccttctctaaattaatttttaaaatttccacaacaaagtgcatcaccattaaaacatcacgttagtggcaattataaaatggtattaaataatagaatagatgcctgaataataatatgtagttttttaaaatccttaaaagataaactacagtaatgggtattgatgaaaaatgtggttggtctatttatagaaaagctaactatagcagacatttttaaataatattttttatttctcctttaattaagtttgttcagacattcatagatcatcttgtacctacaaaaagatattatttgacaaccaagtacactctgaaaagaagaactttataagttatcttttttaattttccttcattgacataatgacagtgaatctcattatgttggtgctaagaatctaccattgtgttttgttttatggaaagaaaatttaaattatgtcgtgtttaaaaaatgagtaaagtaggtcaacacccagctcactccctgacatcacataaatgtaagattaagtaagtgaatgacctaatgttcagccttctaaatattcctatatttcaatttagggagcaaatatgaaagtaaaattaatggatcagttcatacttttaaccttgagtcatgataataactgtattgaagaaaatatcatgatcttgatatggtaggcaatggcaagttacttgccccacaaaatatttttaagtaaaaaataatttcccaagagaattttcaagactcattattggctgaagatcagaatattccagtggttcctttaataataatacttttatatactcattttaatcaaactatagagttcaacttttgaaagcaaaagtttaaattttgaaaataaatttttgaaagtacaagaagatagttatatagacatatgtgatagtgagttaccagtcccacagagatccaagtattaaaatgagcgattgctcactggacaaggcagactaaatgtttttttcctaagggtttcttcttaacattcctgtctcaggaagggctttaattgacagggtaaggcagaaggacaaagaggaagaagcagcactggtttgatcattgacaaagcactttcattttatgcagcctatcttactgtccagcttggtcagaaaacacaaaaagttagtcatgagacctgagtttgagttccagctcttctacctacttggcataaaatctgtggcaagttaccaagtttctctgggccccagtggcttaatccgttaaaaagatgattgtaatgtctacaccacagaattactatgctacctaaattccataattatgtgaaatgaacattttcagatggcaaagaatattacatatcttagtttcaggtaacatacctgatcaagttagaagaaaatctgaggagcacatttccaagacaacccacctacagatttctgatatgaacagacagtggctattaaacaaataaacaaacaccacaaaattaatcctaggtgatggtagtatgaaatgcatagtttatttctatacttatttcaggcttaacttattctcacttctaactgaatataatagagtctcacaagctaagacctggggctgaggatctcctcccgtattgtgagaactctacattgtagaaaagtctagttttattatttgaaattaatagacctattctgttcatgtgttaatatttgaattatttaaagtacctaaaacgaagttgctattgaattttaccaccacagatcaacacatccactggtatgtggtgtgtgtgtatgtgtgtgtgtgtgtgtgtgtgtgtgtgtgtgtgtgtattgtaatatagaatatgctaaattcataagtttccacttgtgtttttttcagtacttttcttaaatcacaaattacacgaagcttaacaaacatccaaaaacactaacctaactggaaaatactctaccatctttaggtcaatgttagtggactgtcttcaagtggaggttgacttcagaatagaggctcttttcatttttaatctatcttttctccttggtcttttatcaggaatgatgtaacaaaagtatatgtatccgtgaatagaaatgtgtgcaaagaataagtggcagtagtgggagaagcctctagatctgtgtctatttagaaaggctggaaaataagaaaatagtagaaccctgaatatatgctatacattttatcttctcagtgatttcctgccttataattctttttaaaaatcacattatagcctcaaattgccaggtaagaggagaataagtaggaaaccaggctgatttcataaaccttcagtattgtcccacataagcatgcattttgggcctgattatgttctctgcaaacactgtccagaaacagattcagtgaattacagtcttaggactaaccaagacaattttgagcaaaaagaaacccctctctaatgtgacagtagaacataagaaacatcagtgttatcactgaaattcagcaagtgcagatgttaatcactgcacatctagctctacctgccaaattggtcagattctttgagtctgtggccacacaatgtgatctgccaactgcagtttgtcacagtctgccactttgttctgcaaaagaagactgcctacattgtatcactaagttcttttggctgttactccacgggaatgttgctaaacaatgagaaatccaatgaaacattccattggcttaagaatcagatattgtataagtcgttcattcattaattcaacaaatacatagtgagaagttactctgtgccagataccggggcactcataagaatttctatagatttaacatcgttagtaatgtatatatagctaacaagtaaggccatatattgtcattagccaatgtcttatcatcagggacagacacatacatatattacagaaggacgtgaagaagagtgagcgacctgtttagacacacttataaggacacacacagacacacacacacacacacacacacgtgaaggaagaaaacagccttacctgttaagtttcagtcctctactacgcactttaactattttcctattttttagcagaaccaccttataagatgttaaggtgtttcttcacgtaatgcctgtctctttcatctgtatcatatgccctcatcactgtgaggaatgggagaaagaaaattggtaactctgatccatactatgcctctgaaatattttagcaacagttggaatagaatcatgtctggagctatgtgtgcgttagaataggtatttaccaaaccttatttttctatttcatcaaatagaaattctgcttttttaacctaactgttcctcttcctactgcattgctggataatttgcaagaaaattgattccctaaacccaactctcaggctagattggaaataaagagcttatagacccttcagaatccccatgcctttagaatccccaaggcctccatctgcatgtttacttacacaaatttggccctagagccagtgaaacacagggacataaagacatcctcattaaaaccaagaatttaagctccatctcgtggtcggatttgaatgaccaagaacataggttttccttgattctttgaattgaggatcaatatgattatcctgtactatttaaaaatttttcggaaaaaaatcatgaaattatttatgaggtcataataaacatggattacattcccagcatgcatttcatgaggctaaattatctgaggagttctagcacctgaaagaccataatttatttaaccaatatttattaagcactaagtataaaatatggcactagggctcaggcaaaaatgaatgagacacagccttttatctgaaagtcatttacaatctaataaagccagatgcatacatatatgacagaaggacatgaaagaagagtgagccacctgtgtggacccactgagaaacacttaagggtgattatgttgaggtacaccttagcaatcttaattttccttcttctacctttttgtttcactagtaaaaataaatcacctcttatacaagaaggaaaagaaactgtttcatgcgctgaattaacacttagcattaaatgcctatgctaactggcccataaaaaagtagttttttttttttggtttgtttttaattgagagatattttaattgagcctatgacataggctactttcccaaatacaaaattttagcatatggctttgattttacgttgtgtttttttttttttttttctgttttaatgtttagtcacacaaacttgaagttatcgtggctccaacagaaaattctagatgtcattagccagtgttttatcatcagggagagactattttacaacaaaattccaaaacaaaacttttcctttattacacagtactcgttctccattccctcctcttttagctgctccattagtctgtgcaaattgcctttcattttattgctttccagggcttctaagtgcttgtttagaaacaaattttcttaagtccaagctaaagtccagggtttatttgattccgttttttttttttttttggacagtcagccaatgctttactcactagtttcagtttctgtgaataagtgccagaagcatggagctgctgagctttatgaaaaggtatagacttttattaccatgaagccacactgcaagcaagtcttgcctgttctgtccctaaactactttcaggttaaccaacagttggaactcatttggcttattgtattattcaggattttcaaatgatttgccattatattgatggcttaatgccctattcaaaaatgtttcatagttttattataaggattttaatctgtattctgctctcatgttagtctagcaatcagcagtcattaatatgatgcgactctattgtagttaaactgttgtcagagaaaaggttattttctagaaattatgttggctgtgcccttcctaacagttcttcacatctctaatatttgaaaagccagtgatatttattatgctattttccttctagtcacttagattacactttcctcacactaccaggaatctcctaattggcaaatccagaagaggctctccagtcctttccttacttcactggctgtagctttttgtactgccagttcctccttcactaagtcattcaaaaatacatattgagtcctacgcttgtcccagatgccatgctagtcactggcaagacaaggtgagcaagagaaccacggtcatcacccacacagagtctattgtccagtggcagattccaagaaaacctgcaattacagcccacaaaactctcttccctttcatgtcacaattgtgttcaatccagattttatctaccttatcagacgtctctatcacagtatcatttgctggctgcttgcccttgtgttaaggatgactgttgctcaggcatccctcctaggctctctttttaccccacctgttctctacagataatttcagctcctcttcagatttcaaccacactccatatgcctgtgatgccagttctctggatctgcaagcccatcagccaccagcttgctagacatctcccctttagtgtccctttggcatcttaaatgaagcatgttcaaaattgaactcattaactttaatatgtactctttatactgtttcccccctccagtaatacttgatttcttggttaattgcattactatctatctagaatattttcactactgaattctgtgaggatagagaacttttctgatcaggcctatatctctaggttttaagaaatttaggaattcaaaatatttgttaagtaaattaagaggttttcttgactcttcttcctcaccgctagcatgagttgttcaagtgatcccctagtcctgcaaattataccaccaaattctctcaccaaatccatcccttttttattatcattctgcctaattcaagccctttcttttatacttttaacatactgtttcttctctgtatcactgtttctatctctgtccctctcagtagcaccctgtactttatatgaaaattaagttttacttcataagtaaattcagtatagatgcaagtgcttgaaataggcagagtttttcatgttcttccaccccaagtcactggttcttgccactgaacactaaactaaacatgaaacattgccttatctcaaagcaggtctttttctcctcacctccttcattcacgtataaactagaattctatttccaagaaataagtcaaaaaaaaaaaaccctaacacctggctaaggtggaggaataggactaggtgggagaggtggcagtgaggttgtttgcttggagatgaaaccaggaaatgctctaacactgctgtgttactacagccccaaatccacatgtgaaaatggcctccaaaatacggctcaatattaggctgctctctttttatcatttatgtacatcctctttcaaagcatgagtaggacacagctttttctctgagcctcactctaaaaatcactgaggttttaacattgtcagaaatttcataatttattggaacatgatattcattttccccttcatcatttcattctgtcccacataagtaaatgtcatcttcatgcccatcaagttccctctactactgattagtaagtttctgttacaatagaatatattgattgtcttccctagttgtgcgtatctccagctttacacagtgtttatggcagggagccccattacctgtgtgctccagaactgtaatgcttcaagtaattccttcatcaggatacagaaaggagatggaaccatctttgggggaaattactaagtgctttttgcaacatatgtcaagactttggatattcgtgatttaaaaactgatctctgatagtttgttttttcctaatgaaggcaggtcggcctgaactatatcacatccagttactacagcctgtcagaggcaaagggctctggttccagtgttttctctatttagtccgtttttcatagtctctagagcaccccttcagatcctcatctgagaggcggtacaaagtcgtggtaaagagtgcatgctctgaagtcacactgacttggctctatcaaagactaactttgtcacttctgtctcacccctttgtgcctcaatttcctcattttataatgggtagatgatatggtttggctccgtgtccccacccaaatctcatcttgaattgtaatccccataatccccagtgtctagggcaggacctggtgggaggtgatgggatcgtggggatggtttcctccatgctgttctgatgatagtgggtgagttctcatgagatctcatggttttgtaaggggctctttcccctttgcttatgcactttctcaagcctgctgccatgtaatacatgcctttgcctctctctcaccttccaccatgattataaatttcctgaggcctccctcaccatgtagaactatgagtcaattaaacctctttcctttataaattatccagtctgaggtatatctttatagcagtgtgtgaacagactaatacaggaaataaaagcacctacctcataaatagttgcaaagattaaatatatgttattcaatctttcttagaaaagtagcttgtgtgaatttgatcctgtcattatgatgctagctggttattttgcccgttagttgatgcagtttcttcatactgtcaatggtctttacaatttggtatgtttttgcggtggttggtactggtttttcctttccatttttagtgcttccacataacaatattaaccttaagtgtaaacgggccaaatgcccccaattaaaagacacagactggcaagatggataaagagtcaagacccattggtatgctgtattcaggagacccatctcatgtgcaaagacacacataggctcaaaataaagggatggaggaagatttaccaagttggaaagcaaaaaaagcaagggttgcaatcctagcctctgataaaacatactttaaaccagcaaagatcaaaaaagacaaagaagggcattatatgatggtaaagggatcaatgcaacaagaagagctaactatcctaaatatatgtgcactgaatacaggagcacccagattcataaagcaaattcttagagacctacaaagagacttagactcccacacaataatagtgggacactttaacaccccactgtcaatgttagagcaacaagacagaaaattaacaaggatattcaggacttgaactcagctctggaccaagcggagataatagacatctacagaactctccaccccaaatcaacagaatatacaatctactcagcaccacatcacacttattctaaagttgaccacataattggaagtaaaacactcctcagcaaatgcaaaaaatggaaatcataacaaacagtctcttagaccacagtgcaatcaaataagaactcaggattaagaaactcactcaaaaccgcacaactacatagaaattgagcaacctgctctggaatgactactgggtaaataacaaaatgaaggcagaaataaataagttctttgaaaccaatgagaacaagaacacaacacaccagaatctctgggacacagctaaagcagtgtctagagggaaatttatagcactaaatgcccacaggagaaagcaggaaagatctaaaatcaacaccctaacatcacaagtaaaagaactggagaagcaagagcaaacaaattcaaaagctagaagaaggtaagaaataactaagatcagagcagaactgaaggagatagagagacgaaaaacccttcaaaaaaatcagtgaatccaggagctggttttttgaaaagattaacaaaatagataggccactagccagactaataaagaagaaaggagagaagaatcaaacagacacaataaaaaatgataaaggaaatatcaccactgatcgcacagaaatacaaactaccatcagagaatactataaacacctctatgcaaataaactagaaaatctagaagaaatggataaattcctggacacatacacccttccaagactaaaccagaaagaagtcgaatccctgaatagaccaataacaagttctgaaatcgaggcagtaactaatagcctaccaaccaaaaaaagcccaggaccagatgggttcacagccgaattctaccagaggtacaaaaaggagctggtaccattccttctgtaactattccaaacaacagaaaaagggggactcctccctaactcattttatgaggccagcattatcctgataccaaaacttggcagagacacaacaagaaaagaaaatttcagtctaatatccctgatgaacatcaatgcgaaaatcctccataaaatactggcaaaccgaatccagcagcacatcaaaaagcttattcaccacgatcaagtcagctttatccctgggctgcaagtctggttcaacatacgctaatcaataaaatccatcacataaacagaaccaatgacaaaaaccacatgattatctcaatagatgcaaaaaagacctttgacaaaattcaacatcccttcatgcttaaagctctcaataaactaggtattgatggaacatatctcaaaataataagagatatttatgacagacccacagccaataacatactgaatgggcaaaagctggaagcattccctttgaaaactggcacaagacaaggatgccttctctcatcactcctattcaacatagtattggaagttctggccagggcaatcaggcaagagaaagaaataaagggtattcaattcggaagagaggaagtcatattgtctgcgtttgcagatgacatgattgtatatttagaaaaccccattgtctcagcccaaaatcactttaagctgataagcaacttcagcaaagtctcaagatacaaaataaatgtacaaaactcacaagcattccatacaccaataatagacaaacagagaaccaaatcatgagtgaattcccattcacaattgctacaaagagaatgaaatacctaggcatacaacttacaaaggacgtgaaggacctcttcaaggagaacgacaaaccactgctcaaggaaataagagaggacacaaacaaatggaaaaacattccatgctcatggataggaagaatcaatattgtgaatatggccatactgcccaaagtaatttgtagattcaatgccatccccatcaagttgccattgactttcttcacagaattagaaaaagctgctttaaatttcatatggaaccaaaaaagatcccatatagccaagacaatcctagtcaaaaagaacaaagctggaggcatcacactacctgacttcaaactatactacaaggctacagtaaccaaaacagcatgatactggtaccaaaacagatatgtagaccaatggaacagaacagaggcctcagaaataatgccacacctctacaaccatctgatgtttgacaaacctgacaaaaacaagcaatggggaaaggattccctatttaataaatgttgttgagaaaactggctagccatgtgcagaaaactgaaactgaaccccttccttacaccttatacagaaattaactcaagatggattaaagacttaaacataagacctaaaaccatagaaaccctagaagaaaacctaggcaataccattcaggacataggcatgggcaaggacttcatgactaaaacaccaaaagcaatggcaacaaaaaccaaaactggaaaatgggatctaattaaactaaagagtttctgcacagcaaaggaaactatcatcagagtgaacaggcaacctacaaaaatgggagaaaatttttgcaatctatccatctgacaaaggatccagaatctacaaggaacttaaagaaacttacaagaaaaaaaaaccccatcaaaaagtgggcgaaggatatgaacagacacttctcaaaagaagacatttatcctgccaacaaacatatgaaaaaaagctcatcatctatggtgattagagaaatgcaaatcaaaaccacaatgagataccatctcacaccggttagaatggcagtcattaaaaagtcagatgctggagaggatgtggaaaataggagcgcttgtacactgttggtgggtgtgtaaattagttcagccattgtggaagacagtgtggtgattcctcaaggatctagaatcagcaatctcattactgggtatattcccaaaggagtttaaatcattctactataaagatacatgctcacatatgtttattgcagcactgttcacaatagcaaagacttggaaccaacacaaatgcccatcaatgataaactgtataaagaaaatgtggcacatatacaccatggaatactatgcagtcataaaaaaggatgagttcatgtcctttgcagggacatggatgaagctggaaaccatcattctcaacacaggaactaacacaggaactgaaacatcattctcaacatcaaactaacacaggaactgaaaaccaaacatcgcatgttctcactcatgagtgggagttgaacaatgagaacacaaggatgcagagaggggaacatctcacaccagggcctgtcgggggttgggggactaggggagagataacattaggagaaatacctaaagtagatgacgggttgatgggtacagcaaaccacatgacacgtatatacctatgaacaaacctgcacgttcttctgcacatgcatcccagaacttaatgtataataataaaaaaggacctagcgtatatagactttctatatttagacattattaacttggtacactcatgcttaaagttgccctgatctgccacccccacccccaacatggcatctcgttacctaaaatatgcttaaagttacaaatcctttgcctacaaatggcacacagaccctttgagatctgtccacactgtgcctctccatttgtatctctcaacttttcctgttaatcgtcagtgtgttttaaccatgtcaagctgcatgccagactctctctggacttcccaaacattaataaatactagtcctttgtgacccagctttctggccaaatgctgtcttctcctggaagattcctggctctagcagttagtcaacttcatatagttattcaagctgtgcaagcttgtatagcctatgtatcgttgcattgtgaccttttttttcccttagggtctttcccacttgaactattccacctgttaagctcagtgcctagcgcaatggtgcactgctgaatgaatgaatgctgtaaatagaaattagtattatatatgtagacatgggattttagcttttattaattaagcttttggtcatttagtgtcatacatcttgaagtttttgcaagggtgaactcacatgaaatatacacatatgataaaaactacctccttggagagctgtttcctggggaatctatagatggtcatgctagctatgactgttctctagtatatttttggaaatggatcaaacaatatactatcccatttttttttcaaatctgtttccctctgaatttctcttgggttgctggacactggcaccctctgtcacagctttcttgctcccacagttaggcaagcaggaaggagtggtacccagtggcttcccttcttcgctcccatagcttggcgggagggagtggcagccagtggcatcttctctcccattgttcagcaagcaagagggagggttacatcttttttactccagctgcctgcagctcggtgagctggagggagtggcacccagcagctttttcactcccatagtttggcgtatgggaaacaatgttacagcccttttactctcacctcctgcagctggtgagcaggggtgttagagctctttttgctcccacagttcagcaaattccgggttcttgtcccatgactaagaggaatgaagtcacggacaccggagagcgagtaaggcagaatagaattttattgagcaaaagaaaagctctcgacagtgagtgggcacctgaaaatgggtagccatctgtgaagctgagtccggggttttttatgcatttggaatgaggaagcgcaggctgtaggtaatcttagaaaaggcaacattcgattaaaaaatgataaaaaagcattattcagaaagaaccaattgaaaaagagtgggtaacaggaatagaagttctcactctagttcatggactctatctggaattggtagtttggttttcagacttcagaggatccttggcttgtaggtcaagtttcaccagggacccatccctgtctgcctagaaatctgtctcctgacacctccattcaagtgtcatacatcaaaaagctacatattatcaaaatgtgtttccccacagacagattcctttgcaaaactggatgggagtgaacatcatggctggccgtcttgtgctgtgtgacagaacattaacatgcccaaagccagaggtctagaagacagtgtccctgccacagagggagcctccaacgtctgaaagtccgacagcattgactttaactcattgctttataaaaactgtaaacaactaaacccatgaggcaagagccaaagtattacagctcagtcaggccacaccccctgcaaactgtttctggataaaacagtcataacattggcttgtgtgctgggatttcacagtttaaaatatgcatgattagtgcctatgattgatgtgttaactaatgaagcctataccagtttagcagataatgctggcaggacgtaaggtgtctcagacaatttcccatgtggtgttgcatcagtctaaatccctttgaggtcacaggcaggatattggtcgattttaatgttgacgattatccaaaagaatgaccacatcatgaacacattacataatgtggtgggggtttcagtcttcatatggacaaaagaattctaacatcctaatggatgtaccaaacttctggctgggatagatatgaaatttagagaagagatgagagctgccttgtcaacagattggctccacatgccacatgttggcataggtaagagatgacatatgaacaaaagcagttgtcgaatactgacacaagggagctttcctggactcagtgagcatgaaatagactagccttaagcagtggtcacaatgaaatcatggctaaagaatgtttccgtggggctgtctctgaaggcagtaccccagagctccttcttgctcagcacccaagacaagtggaccacagagaactgcagcagtccaaatggagccgagggcagatccattaacaaaggccccaactcacatggaatggaatgaatgcttcaagaaacaccaagcctgaagccgggcacgggggctcacgcctgtaatcccagcactttgggagaccgaggtgggcggatcacctgaggtctggagttcgataccagcctgaccaacatggagaaaccttgtctctactaaaaatacaaaattagccaggcgtggtggcgcatgcctgtaatcccagctactcaggaggctgaggcaggagaatcacttgaacctgggagccagaggttgcggtgagccgaaatcacaccactgcactccagcctgggcaacaagagcaaaactccgtctcaaaaaaaaagaaaagaaaagaaaagaaaagaaacaccaagcctgatgcaaggcttggaagagcagactgcctgcagctgttaaggctgtgtggaaaggcactgtggaaaatggaaatcaaggaaataaagcagagattcttcatggcttgtcagttattttactctaaaggatatttcaattgcaatgaaaggtttaaatagacaggtagctacagtacaatgtttgcttctcactctggtacacagcatggtggtagttgtctacctgtttttgttgttgttttctaattcctcaggatttaattaatgttttacattcagtattatttagacaagctcaaattataatcattatatttacctccctaaattttattactatttcagtggcctagggggagttgtttgcagatctaaccttcataatagtctattaaatggctgccaagtttcaccacctcgatctagtctgtgcgagtagtgaaataagtatgcatttatcagcctgtgcaggacaaatctaagagtctcctaataaatttaaaagagcattactaaattcctctttaaaaaatgtaatgtcccattattagccctctccaaattcccaatgtcattagaaacctcaaggtgtctacatgctgatagcatttttaggggagagggccttggattcaagataaagagtcctaacttctgcagatgggcattatttcacaatcaccctttttttcagttttcctatctgtagaatttccctccataaatatcacatgaagaccaaaagccataagtgaagatttataaaatatttttatcataagagtgatatgccacatagcatttgagggaaaaaaaaatgcactgaatgaccagacctacaggaagataatcctttatctctacagattatttctactttaggaaaagaaaagggaaatttatggcagataggagttgagagcagcagaagtgttaggaggaagaccagtagagcagaccagccatgactgggttggagtttttatagggaagagagcaaagagattttaagcgggtaagacacataggtagataaaaacaactttttaggaaggttaattctgtattacatgatcaagcttatgtcaatttccactttgcagtctcttcaggagatttcagcaggctttctttttaaattttctttttcaaaaaaaaaaaaaaaagtaaaatattccttatctgcaatgcgagctgagcagcacagtgctccttggtatttataactcatttcccttcctgagctagcatatacttttaagccaaaaaaagatatacccttttccaagaccttctctgtcttatgccaccaaggaattccacttcagtagttgcaaaatcaagggattttcttttcctttatggttttggagactccccaagagctaaagcagaaaaaaatcaacactagatggccctagaagatgtactcttcatggttttgtctcttgtctgactgcccggagaagagttccttaggcatttacaaacacagcaatgccaccttttagccccactctttagggattttacatgactaattttaattgcataaaaggaactcatctttatcttggtgtgtgcagtgcaaaacacttaatgtagggtctgactctattctacagtaagtgcagtaagtgttagctactattacctcatcagcagacctgcaacaagagagtcctttgttactacagaattctcctgccctaatactgccaaagtctgcagttctagctgcatatatgcagttcctggtgcattggcggatctcaataatatttggtttgtggatatacaagtgaacaaagggctttgggtttttgtttttgtttttgtttttagcagaaactaattcatctggctaaataacctaagaatatgtaggaaaaaaattacaaccagaataaattcttgtttgctctttataaatggatcattggcaacctttgaggtaagatttgatgcatctcttcagtagaaattcagcaagatcaacctcctcattatgtggagcagcacactgagtaataagaaatctggcatggctacagtatcttgcacataggccatgctcaataaacatttattgaatgactgtcttgttaccaagactttgtagcaataagctttaggggttttagcctgaccatctgcttggctgggatgagtcgtgatgatagttcacattgggtttgtgtttaccagttcctaaaattcaagtgtgttcagatgtagatcctctgttagaaaatatagcagtatctgaaaatgtcttgcttttcaaataaaaggtgcagaggtgtgagtgtttttgcactgttggtttcagatggaaccacaagcatttggcagcatattgaagaagctgtcacaatcgagcttttcctcttggggaacctcaaccaaagctcagcggtcatttcccatggaaaactatgtgcctttggccagttgtgctaagataacttattggcctctctgatgtcagctaatttctgtccatcagtcctcagtgcctgagtgactttcctccaattcatatgaaagtatgcagaaggaaagttttacagctttacaacacagagcaggccttgcctttttatcccttggctgtgagcaccagtccttagccacatacattctcttgtattctgctccctttcctgtcccacattcttcatagatttttccacgttttctggaaaaaaaaatcaagaaaagcaatttcctaagataaatgctcccacctgcccttgttcttccagaaacacggatgggctggttggttcgttggtatttcccggtttgcttcccttttccctaagtgcgtcactgactctttgctcccgggagagaatgagcatgtggaagccagaggaggcctgttcacgcccctctcccctcctagcacctcccggcctccttccttgtatgtgtttccctttaatctctcaatcttacatctttcatatttgcaagagtgtacagaactatttgaggagagagaactggagatctagaacttttttttaacagattttatttgtcatagttccttaataaagaggaatgagcatctcatagatgagtgcatatggatgagcatgatacagcccagagcccacctgagctcatgagaaaatccccccagtgaaaagcacgccggggtgagggtggagcggagcgtggaaagcaaaccaattggaaaggtgttccctgtattaccaagagcccaggagtcagtgtttagatgttcacttcttgcaccggctaacatgacatagctactttgtgtcctcaagcaagtctcttaactctcagaaccttagttttgtcatttgtaaagtttgggtagtaaaggctgctctcaccacctcacatagtagctgcaagagtcaagtgagtttttttttttcaagtgagatttttaaaaagctttgtcaattgttaggtgctttaaaaaagtcaacagagagtgttataactgaaagagatactttaaaattgctatagctacctgctattaactaaaggcattaagaaacttgaaaaccaacaccaagaaaaagagtataattaaattccccgacaaatagtaatttcatcttattcaaatagtcttcttctgaagtgatctcagaaaatatggagctatttacaggattaatatgtcctaacttcccttttatgaggtaaataaagggggaaaaagctaaggtcatagaaaatttgagggttattggttgccagaattggcaaaattaatttatatttctgctttgaaacctgtttagtttctgtagaaaggggaacttttcaaattaaaactgtagtctgggtcagaaagctatcaaatagccaaggtaaaatagggaggaatccaggattttcccaccattcactcgtgctgttgactcctgccttgtgggcctcatcttggtcaggagctgccactcaccttttctcacctgcagaggctccaccaacctaagtgggaagattggcttctgttaccaagaagcagagcataatgctaagggaaggatagaaaaccctttctgttgtgtttcttctatacttgctcatcatttgacattgtttttgcactcccttcattccttcaaatctcatagactttctggattctgagtctcagaccttgaactacaacgtatgcgtctgtctgtctcctgtggtatgtcattacttccagatgctagtatggaaagtggggaagaattaggcattggaattatgataagtctgagtccaagtctcgactcttccactctccttgcacaggcaaaggaaacattaggtattcaaaaatggccactattattatgtatgtcacttctaaacccacaactgatttatccattctctaaccctttacttttgctgtccttgcttgcttgcttcaaagccaccccttcttgatcctgcatctctgtctcaaccttttatctgatactcacacctgaatcccctgccccagctctgacaagatcatgaattagagtttcattgtagaaagatctatggtgaagagatgcaatgaagtatcaaggtaattcccttctaaatggaaaatgaccatcacaagtatttttatgtcccagtatttcattttagtgagatttttaaaaattccttcaggacatgtaagaggagaaaaaaaaagaaattcaaatagcaaactaagaatgtatggtgttcatttgtaataagcaggaaagttaaatatatttttaaggagataaaggagctaaatcataacatagctgccattcattgaatgcctactgtatgcaatacaatataccaggtgctttaaataagttattgagtttactcgttgcaaaaaccctatcagtaattagcactattattattctcttttataggtgaagaaatttgggcctagaaagattagtctagttacctaaagtcacgtgatctgtatgtggtagagccaagattcaaacttgattttacttttcacggcatagcgtgctcaatgtagaaccagcctgcaagagtttcctcaaaggctgtgtcacaccagggccacatataagctcctgggctattctatcataaatcagaagatacaggctaagttataagaataagttattattatagtaagagtgtatgctatgttaaacagaccattaaaatgataaaattaaataataatcactgacatttattgaacacttgccctacgccaggcagtactctaaatgctttgtaagtatcaatttagtttatccttacaacaatccagtgaagtacatattataattattgccattttacagatgaggaaattgagcacagagagttaagaaacatgcccaagtaagcggcagttaagaattaattctaggcaataatgtaccagagcccacatgtttaccctctatccaatacaaactgcctagttaatttaatcctgtgttctaattcttttgaattctaatataaagcacattatcttgtaaagctttagtttaaaggtctgccacataagcaacagggcctgctcttcaccatatgtgttcataatctggataattccctgatggggatcatttggagcaaacatttcttatggaatgattttctatgactgtgctatgctcaactgccggagcacttcactgctatacctcaatggaatgccagcgaccgactgtctttctatctacagttaatttggtggctaccgctatgctctcaggagccagttgtctatcatatccctgcataccccacacctttagtccactccaagaacttgctccccacagtaggcctgtgagtctgaggttatatactcttattctactggcatcccattagaaactactttctgcggctccaatattccttctttattttgtcacttgggatttcaatcagatattttaaagcttcctgtcctttgagccatattattttagattctctaatggtgggattatacctgtaattttttctgaactttttgaaacccacttccctaagtttagtatatatgtctgaatccataaggctcaacaactcttcttttctgacccaatcgcctacttctcccttgcctctcagactcttccaccttgtttgcaaagtttgtttgcctgtctctaggcaaacctctatattttattggaatgttccctttaccattttgctctggtaaggtaatatgatcagtttctacttgttttgaatagaatgagattgccaacagacaggcagctgttgtcggatttggaatctgtattagcaaagcatcttccttgtttgttctccaatgggatgtctacgtgtagaaccacagtgatgtcacctcacaccttcccctactaccttccaccatgtgttaatcttcaagataatgaattctcctctgctgtgtattttcttgccttagtgtgatagggaccaatatttatcttaaaaggattgatgtaaatcttccacccaaagggtttagtttgctttgttgcagtagtttttacaactaagatgacatattcatgttctggattcaaaaaccttttaatcttgctaatacttggaacatgtattagtacttagcagtgtccaccaactgctttttagttcaccttccacttctcaagggagtgctcagtaaatagtacatgctcaattaataatagttgacattattattattattagagaaaagacatataaagttgcagttttccaagagacaatatgacttagcaggcaaacagaggatattggcgtcttctctgccatcccttttgacaccttacagaaccttggtgagattaattaattactcatcttccactgtccctgaatgcaaaataagggtgaccttatttcagaggaaaggtgacctcttcctctgaaagcttcatgacttaacaaaaagtaagatacattgaatcatttgaatgccaactgtgaagaataaaatattgagtaatgcttactcagttctttaaactattgacctagccatggagttagcaccaagatcataatttctgcccttttttgaagataaaaatcaccatcagaattgccagccaaggtaggaaaattgaagaggaaggttacagtcctgaagagcaagcactcatatgggagaattgggaaaggcaataatatagcggcctcagaagcctggtgaggaacaaaagtataaatgcccaataaccttatctataccacaacatataaaattgggccttggcccagtcactcttagctaataaagaaatttatctttagaactgtgaatattatagtaggactgggatgtgctgcctgcattcccacttcgagactgagcctctcattttcacagctctgagcagagtccttctccagaaatcaccctctgctgagagaagctgcctctcacaatggccatgccccctcgctgaggacagcctccatccatggataggttcagagacttagcctcttgtctcaatgtgatacaactctaaagaaccacccactcaggcagaggctgccgcaccacaggtgaacttctccctctgccacattctgctctgtccccccacaccgatgttgttcctgtggctacttcccaatgaacctcctgcacacatgtctcagaatctcagaatctatttcctggggaatccaacgtataacgtatactacctttgcattctaaggagcaattacaactattttcaattttaagaacatcatcaatcatacaatgatcacagaattcccataactaagtgaatctccctcttgacctttgtgtgggctgcatttgccatgctatgtgatatgtagctagtttctcaagtgcaagtgacttgaatggcccccaaataggggaaatattctgaggtattgagactggccagttaccgtattatacttatgatcatttccaaaacaaaagaaaaagatggcaagtaatcaatactccttggccattctgttgaaggttggtttgtgactagggagactgtattagctcctgagggctaaattaccacaaacttggtggcttaaaaaaacagtctgggggctagaagtctggaatgaaggtgttggcagagttgattcctctgagaccctgagggagagtttttccgtgcacctcccctcgcttctggcgttgcctgcaaaccttggtgctccttggcttgtagatgcatcactgcagtctctgcctctgtcttcacatggtgaactcttcggtgactctcccgtgtggcatctccttgtatcaaaagtagggcaggcctaccctaatggagtatgacctctcacctaatcttaacaaattacattggcaaaggccctatttccaaaagaggtcacattctgaggttctggataaacatgaacttttagaagatgctattcaaccctctgcagagaacaactgaggaaacaaccaagatctgcttcccagttgatacctgtatttgtgctgtggatcttttaattaactgccttaaaagaaaacacagtgacccagatgtgtgcagtgggcgccacccaatgacagaaggctccttgaaggcttaatcaattagataattagtaggaccaacagggagttggtaaagcagcataagtaaaaccagggaaaggatcattacccagactctgaccattaatttttagtcatactgaaaaaaggagctttggggaaaagacagatttgaagagatattttattcactctcatatacttcattttctaaagcaacatgatgtggtagttgagttcacacagtaaaatattagataatttgaggaaaagacctaaaggaatgctacacaaatatatttagtttggccacataaggactccacgtatctcaggtcatgcacaggggtagcaagtcctgtcttgtgagttccataactttgattcctgcaggaagaccccagagacctgcaaaaagcatcctccgtctactaacatcctttctctcatttttccctcttacctgacttgattataaaattaggaaatttaaatttaggaaataatgaggagacagctagtaagcaaagaggcttcccaagccacacacacacacacacacacacacacacacacacacacacacacacacacacacacacaccagaacacccttaggaggcatttctaagcatatccatccataaaatatttttctgtttgctgtataagcagaaaggtttgcatagaatatgtcctttgtaatggcttttgcctctgagctttctaacactagcattgatcaattatcatcttctccacaatagactaatgtttgaacttggaactcagttctagaccagacactagaatactcgtgccatactttcggaccaagccagagagaatgacttcacccaggagagaaagataagaaaagatcttgatgtgtaagcctcctttatttacttgccatcaatcaccaaaacaaagtggaaggaagggaaagggaactattaacattgacccatataaaattgctgatattcaattggttttgacttttaaaaattgcatttgcaagtgattctacctaatataaaattgtatttaaacaactactttttgccagtcactatgctaagtgccttattcttatattattctttataatcctcaatgtaaactttcaagattggcattataatctctattttctgtatggaaaagctgtggcacacaaaagttcaataatttattcaaaatcccataatatttgaacccacacccacttcatgtccagtaaagtcatttgggtctgctgaagtatttctagactttatagtaagattattttcaaactctattgtcaaaattcttgaaattgcaaaggctactccgtctacaaacttcaagggacgtaagaggatggttacagactgtcaagaggatgtctgtggtacatgggattggtaatgtagaaattaggcagtgctttgaatgttactgacaggtcacagcacactgacagcaacagggaagaagatattgtggaaaataagacaacctcttgagaaggtcatctcagtatttgtatcactgatggggtttacagaaaagcagtcactttatccactggcagctgcataagttttaggttgcatttatgtaaagaaacaaataagtaacaagcaagctggcattggtggtttctgggactgaggaagaggagggaaaagaaacccctagggctatagctgtaacatacttactcattcgcacatttgcagctctatgtgtctttagcattctgtgaaagctgatgttcataatgttgatcatggaacatcgagacaatactaaattatgtttaatatagacttgttgagaagcagagaaaaggatattcgttttaagcaatttcgcagtattttttttaataccctaaaacggcaaagttttagctcttgtagagttaatgttcacctttctgggaaaactctgtaatccagaatgacttattctctgagaaatccaggtagtttcatacatgcttttgtaccaagtcatattaaactctttcattcatagttttgtccatgcttttgtacttataataggttgcaactggtataataattacagtagaaagtcatttattatgtggatctattaacatctgattcctcattaagcattaagaatattgccaaatctgcacttttattctttctgctgacagttagttttcacagtgcttcttgatttacttttatgattgaagtttcaggaataaatgttttaatttaatgttccctcagtataacagatttgactaatagtttaataaagggacaccgcaagtttctaatagagagaggtttgcttgtgttcacgagggatgatgcgcacatcttgatgaaggctgcccatgacccactgtgtgctgcacgtgtccgtttccatccgagcatctcagcacagcatttgaagcaggtagtgagaatcccagtcatggccaggaaggatgtgaagggctaacgggggacctggatattttggagggcctcagtcttcctctcttgcctcttctcatccctctttacagaatatttcctaggctgtatccccaatgaacttctatcgatttccaatacaacccatatgtctttgcacctctgtgtgcatgcccttacttctgccagaaatcctccttcatcattctcctggtgaactcctagtcatcttctgcaaggtaaagtccttctccagaacttcacataccctctcctgcctgcctccctccgttactacccccaggactctatgcataactcttccagtgcattcagctccaaattagtcagagttgcatttagcttaaaaggatgcttcaccagagtgggtactgtgcctatgtagcactctgccaccaataattagcacatttaccttttaaaaagaattgatctatcagctgtattcttatggtggccttctacattaatgaatgacataatgtgttttagaatggactagcctgggaagtaataccaagatcttgatttttctaactttcccaatggtttacatctatctattctagattgagattttgtttataactttgagatttaccttgtgcacaatttggaaaagggaaaacaaacatccatttattcataaaatatttcttaaatgcctcagtcttaggtgccagggaaagtctgttctcggcagcatataatgcttacagtcaggtcagattccttgataacagcagggaacaaaaatgggaagaacaggcaggctttccggggcagtgttgatgtggtaagtatgggaagtttggcattgggattagatttttcctaccctgaaaaccatcaataaaaatctctcctcaaggctgaatttcttaattaattcatttcaagccattaacagagattttaaaaatatggtctatgtcctcagatatctttcttttgagttgagcatattcttcatacggaacaaagagcaattccaaagcaaagtgaaaactggacagaatggtgtaataacaatcactgacttactgagtacttactgtgtgctatacttcatgtatatatattactcctttaatcattataataacactgtgagtaaggtatttttagctctactttacagatgaagaacttgaggcacagggaggttaagtgctttaaccaaactcatgcttggatgagagcatggccttgaacccaggcagttgggtgctaaaggttgttctcataaccaccacgttacacttcctctcaatgcttaaaaaggaaaaattatttactcagaagtattgaaagagagtagagcaaagaggtcctggagtggcctagcatgacctggcatggcttcttgcaggtagagagatttaagccaatatagcaggaatggtagatgttggcaagaagtctacgtgaatggaggggcctgaaaaaaaaagcctaagtctgggcatgagcaagatgggaagtgactgatttggcaggcacagttgtctctcacacttaacagtacctttcaaggccagaaaggatgttcttaattttgaaactcatacatcaagtatagtggttaggttgctttttgcactgagctgtggagaaaagtacaggttgttacaaacctaattaagataattatttaatagaaatctattttaaagttttgaaaaatgctaacaggaatcaacttttaaggataatctattcagagtcacctcctattaacagtcatgttattaaccaactcagggcaaagcatgattatataatagctcaagaagaggtagtgttgtctcattttactttctgggacctaaacacctagggaaaaataggtgataaaactgaagctgtcacaatccagcctctttactcccaaagtcagtgccacacaattaaaataactacaaaactcagttaatctagatagtatactataaagataatccttaaatatgggtacatatgagtgtgtgtgtttgtgtacatgtgtgtgtttagttagaaactttgaacacagattgaacttgaaggcatttcagcaaggagagatatttggtaggatatgaaaatgaagtttacggttggaataccttcagaacctcaagtgcagcatcctgattctgtgaagattatgttttattcctttacctattcccacgtgtaatactttattctctttgaattggcttctaatgcaatttaaccctgtttttgagtgtccactagcttaatttcttttattaatatgaattcttctccttcctactgaataaacccagctaatgtgtttttttctcctttatcatttcatgcaaagcaaaaagtaaataaggaaagaatatgattttcgcttccatttttttccccaagcctaaacaatggaatcggagaatctgtttttgaaatctggaatcttagtatttgctgatcctatggaatcaggacacttgattagctgcgagccaagtcatcaggcccacttaatacaatactcagtaaattaattcaattttactgatgtgactaaaaactaaatttcatatcaatataaacacttattaagctgcaaataccacatcatgcaagctgttgaaaaagactcatttttatttatagatgaattctgataagaatagcattagaagtattttagtagggaaatgttagagtgattaatgtgtagttgtttgcatttttaatatttcactcatatatcagattaggatttgtgcatactgtcagaatttattctgttcttgtcaaaatacttattactgctgacaggtataacatatccacattaatccttaattccttgattcaattttctaattgcttttttggcatgcgatggtggccatttagtcttatgtgatgtattcatcatatggtataaaaatgttctttaaaaattagatgtgccatttaaagtaactgagcaggaagaaaaaaatactaaggattggaaattttaaatttcaccatacttagacaaactattagatactggtatgtcacagattctggaggttgtccataaatcatagtcacagaatgttaaagaggaaagggaccttaaaaatcatccaacctacctgttcattttccagttggggaaactgacttagtaacaagcccaggatcacacagctagctagtgggagagctggtctgagtacttatatgttctgatcactagtcagaaatggggtaggtatttgcatataattgttataactggtattctaaattgatttttactattaataggctgacagaatgagagactccttagcttcttaagctgtatgttttagtaatattgtatagtggctgaaaacctagattctagaatcagagttccagtcctggatctgcccctcactagctgtcttaccctgagaatacagtctgaccgctctgaatttcaattacttcatctgtaggaaatggaaaataacagtatcctgctaataggactgctgtttaggttacatacaataatgcatgtaaaaagcttagcatagcacttggcatctagtaagtactcagtaaatgttacatattattattattagtgttttactatccctttaatatccacaatttggagagaaacttggtcatgccttgtcgcttatttcaccatgtgacctctgtgacaacttcatttattcattcattaactctttcacttaccatgtgcaatgcactctagtagttgctataggtaagacaagaatctaacatgatatctgccttgcagaagcagggctatacaacatgtacatcaataagtataataaaacattgggagacataggtcccaaaaaggtggcacaagcaccgtgcttggacatttcaaagagaggaagtgagcataggggatatagggatgaataagaaaccggacctgttctcaaggagcttgatccagtgggaaatagacatttacccagctgttattcaaagtagaaaataaagagggtcacaaaagttaaagttaaagaactaaagagggagaaactaaatatctcagatcagagaaggctttatagatgaagtgacatttgagttggctttgagggacgcataagatcaggaacgttggagacctgtgggaaggatgccttagacagtaggaagattaagagtgaagaaggcacagatgattctgaaaaccctgggaacagttgttgaacagttattaatagcacttaatttgactaaaaaatagagcttgtgcagaataaaggatgtgattagatgagtatgtagggaatgtcattttggactcaagcctcttttgacccaagacatggtcagcacacgttttaagagttaatgtctttaaagaactttctagttagtacccactactttttattgtcttactctagaggataagtcagtcttcctacctattacaggcaatatagcataaagttaagcatacaagctcagaaaatggactgcattggtccaaattcctggttatgccacctattaggtctacaactttatttatgtcacttgaactcttagaccttcagtttcatcatctgtaaaatggaaacagtcagtgtctcatcgggtaggtattgacatcaggcatatagtaagtgcttaataaatgttagctattattactgtgttacccacctgtgccttgaagcgacttagtttacaagttctgctttggaactactgaaaaggtttttgagaaaggatgtaacatctttttaatcttgagtccttgaatgttctactaaaccccacttaaattgtagtgactcgtccaaggacatcagataattctgttaagccctcacctgctggaatatggtttctagtgatgggtctcagtgtgatttacagaagtgaatccctcactcgccattggagagggccagtggaagaacaagtagccagctttacccattgatgttttccaaacgtgcagtgattcatgtagcaggagtttcccaggattgatcctgagctcaaatgaacacctcattttcagaacaaattattaggagttttaagaactataccttgaaaatcttcatgattctagaagcttctctggtaacatttttttctgtttgtaatagctgaaaaatagaaagcatttaatatagaatttttgcccctaaaacagcaacttgaaaataagagtacaacagttttaaaaacactagactgaacaaaagcagtctttttaaaagtgctgtgggcctaatacacagggactgctaattacgtaactgtcagtgatgttttctggcagagcctaacaccagcttcttgcagtacaacgaatatgaaaatgcctagaagtaaatcacagttgctgagtgctgtgggcaaacaaacccaggccttatctctttgaaaggcagcaatggaaaatacatgataaattgcacagctcagtgaacatgttatgtcattgtgaaatgattttgattcatggttatgtagttatcacgaaacaactgccaaaccccagggtatcagaaacattatcatttgtggggttttgctattttctgttgtaaaattcaagtgctataaagagatgtttgggtttttttgtatataaaattctgtattgaaagtgatatttgccacatactctttggaaataatattttaaattatgtgaatttcttccagaagtatcaaagagctgtgctagtaactaatattttaaacagaatgaataattcatatttttgctaatatccttttatgaaaattattttacctaaaatagactaagttgtaagtcaatttgattttttaaaatagaagtataatctccttttatatagcttatcaatatacagaaatttctgaatgttttctatacaatagcagtagaactaagaatgaaagagtaattttttaaaggaagattttatagaagtagcttttatgcaggcataatttcctttccacgtttgagatattctactccactgtccttatttgttgctaagtctctgaagtttaaagtgttaattagaccatattccacctgaagtttagttattttttgttaatttttttctccgttgatgctgttgatgatttgatgttttgaaatattttctgcttgtgttaaaagtggcagaaagatagcctggcaaaaagatcaaattgatgtactactgaatcatttgtcgtttttctcaatctcctaaaccaagacccactgtttctcaacttttttgtataaacatacaattctactgttctaatttttgcagtcgagttttttttttaacatgcctttggatatgctgaatagtatcagttaatacactgagagtttaaaaagaaaaaacaaagaaaagcttgcccgttggtagaaatgattgattgtttcttaggtatggtttttccaatatatcactatcgtttaaaccttgagtttattttatgttctgttagtatattttaatcaattgacctttacatattgtttgcatttattaaattaaaataacttttagtagcctgtaaatatgatttgaaacatttcatagtatttttcttttagctttggaataagacaaacctattctctaaatatttacatcactggagaatatctatgtacttatgctgatttttacttaacattttcaaaaataagtctgttaaattaaatgtaagctttaaagtgtaaaaccatagatcatgtaacttgatacaagtattgcaacatggcttacagcattttcttggaacatttttatgccctttgcttccaccaccatcgccactttcacctttatattgaatgctcccaaaatgtatctatatgaggataattttaaaacatgagatttatgttgctataaaggagaaatcctttataaccacataaaaccattgtcaccagaaatttcagtccaagttttacaagaaagcaggcatattttatctttaatgcctcattaaactttctagaaacgacagtattctagaatattctaggtgaatgactgcatatgtctgtatttcttcttaaaagtttaaatatcatcagtgaaaaaaacctgaacaaatcatttgttctaataattaaagccgtggtacttattcttctatttaattttgcctttcctcagaaatgttgctttgatatatcaaccatgtctcttctatagctctttaaatgatggccaaaactaacattcctaggctaaactgatagcctcactattccaaagatcacattgtgtttaattccaaatttcatatgtggatttgtgtacacgtgtgtacttgtgcatatgtttatgtgtacatgtgtggaggtgcatgtttgcatatgcacacatgtcataagcctgcattgtgtgattaagaatgtgaactcaggaggcagcctgcctgagcttaaatgctagcccaactactgctaactagctatatgaatctgagcaagctttgttaacctcttgcttcagtgttctcatgttacagagttgttgtgggtttaaataagtcaatatatgtcatgcactttgaacacctaacccatagtaacaacttaataaaatactagctattactattattattattatatatttatttactctatgttatttctaaagttatctatacaagtgcattgatgggtgattagtaagtaggtatttcactaaaacaatattaaagatatgccaacctgatctcacatttacatgtggattcttaaaaaaagtcaaagacatagaaacagagaatagaacaatattcaccagggacagggagggggaggatatgaggagatgtaggtcaaagggtacaaacttgcacttatgtaggatgaataagtctatagatctaatgtaagcaggaggactgtagttaatactgttgtattgtatactgaaaatgtgctaagagagtgtattttaggtgctctttccacgaaaaaataggtagctgtatcaggtgatgaatatgttacttcgattgactgtagtaattatttcactatgtatatgtatatgtatctgtgtatgtatatgtatatgtatatcaaaacatcatgttgtacaccctatagacagtaaaaataagaaaattaagatatgccaacagaatattttgaattgtgatcacttaattagataaactatgctatgttatacatcattggtgagaggaaacaattgggaaaaaggaacaaaagttgcataactttgtggctcacaagctgctcgtcaaatatagtgaaatttgttgatttattcaagtgtaggccaagtgcacatccatagtgtgcaaggagctagtgttaaaataacacatggtgtgtcctgaacaactaggaatgtacagcacagctacctaaaggatagataaggtgaaaattaaaatagcaatgctatgtcaattttgcaaacttaaagtgggttttctttttcagggggcacccaagccaattgccattgaaccatgtgctgggaacagagctgctgttctgactgtgtttctttgtctaccacgaggatcatcaggtgcccctccccctgggcagtcaggtatgataaatgaggagccttcagcagttaagcaaaacttgtagactgaacagaagaaataaacaataccactaaatagcgcagtaaggacctttgcaaggttctaatttagagcatggtaaaattttatgagaatacaaacttttacccaactatctagatacctgcattgttataaaggtagatttcccagtgtttctccgaaaaacacatgttgaatatgtgtttatttgtgtattatacacacatgtatgtatgttcccattaattgctggaattacaatgagaaatctcattagaagggccaccatgttctagacccttccagccagcttcctttcttccagtatgtgtggcatgttggaaaccaaattataaatatgattagaaatttgctttgtgaatgtggaaccaaactagggaacgtgtatgtttggaacgttgagtggcatcagaggatgatagcttcacgcaaccatctcagtaggtttaagatatgccattgctttcagcaccagctggagttcatggaccagggaaaccctctgtcttaggtgggcacagccagcctttgttctgattctccttttcctgtaggaaaagcatgtttttgatttcaggataattatacctgtcctcttagagctctgctcattgcgatggtgttgtccacattctaagcatgctcaatgttgaatataaatcatacttaaattacagaccacacttttttctctctttttgcatatactattccatctttataattttgaatttttctgtctcctgattattttatctatccaaccactactggaatgaatgctttttgagggcaagggtgatttcaaatctgtttttctcttcaattccccttaagcataaaataaaatgccagcaagctggcaagttctcaataacagtaattgatgatgaaccggcctccttgcttattttatcttttcttacttccctacttggctttgaatttgctcctcactttcttgacttgtgtccaaccagacacaaaaaatggaaaatgtactactttatgccttgtaaacgttaggtattcatgtaacagaatttttcccatatatgggagcagagagtttccatcaccttcagattcatcattcatggtacctgatgatatcttattgcagaaatttctatccaaagttcatttatggatgtttattcaaagaaataaacattttctgcaccttttcatacattgagtgaatgtcttgttcttttcctttcagcacctccaaggtaaatgggatgcaataagtaaaatagtttggcactggtcagataagatggataattataggtacttgcacagctaatggaagtattgttttaaaactgggatgatttccaaaacaaacacttcactaatgaaaacaagtctgtgtgatatacaccaaggtttttctcgatccttcacgagatgggcagactgaaggcaactgccaattctctgtccctttaacctttgaagtcctttttgactgatatgaaagagacaagtagcagtgtgaaccattacctcagctgtgttttctaacaactgcattatgattactaatgttaatgttatcttagatatgcatagtactttactctttctaaaatgttttttctgtttttcacatgtgatcctcatgacagggttgtgagataggtattataaaactaacatcataaatgaggggagtgagacgtagaaagcactgtatatctacactcaaggaataattggggagaggggatactagagtatagagcaaaagaataaaaaatacttactgctagcattccaggtaattgttcctgatgatttgtagcagaaagcctctctaaaatcaacagcccatgtctttacaaaagcaagcatttggatgaatactgaaaatgtctacagggttgatagagctagacaaaagattgaaatagcttaccatactttttacagagcctgaggatgaaactatgatgagtatctgcgtacataattcagaatgagcttgttctttgttttctaaaaacaatctagtagatttttcaagctcttagaggagtaagacagtggttctactctttaaattgcagcattatctgttatctgcatcaatttggaagatgggtaagaggggtagatggactgatatgtcataaagcaagtaaagtaaaatgttaatggtaggatctaggtgctaggaatactgatattcattataaaattcttttaactttgatatatgtttaaatatttaataatgaaatgttgggaaacaataaaacaaaatgtcttgatttcactgcaagaaaaaaggcagtatctgtagagaaaaatttttccaatatcatcatctaggttttcccagaacaaggcaaatactgacaccaatatatgaactaagtgactatttttttcagtgctcgtccaaatatttagtgtatgcacagccaattaaaacttcacatatttgagaggaaatatatcccagtgattatttgggaaccatattggctcttgggaaccaaatgctgacactggttatctcattgctgaagtttggtttattctgtgtcttcacagaaagtccttatatatgcctgtgcttatcccagtgccctacacatagaaatcagttaataaattattttgataatgatgatgacaatgataggagacttgggaaatgtgacctttagcaaccacttgaatctgttagcttcagctaatttcagtaaaatgagcaacagagttcaaattcatttaccctttcccagattcctctcctagaagccctctatgttctcttgagcctcctccactatttgtgcagggtgacaggttgggggagttgaggaggaggtagaggtggagctttgttggcagactcctgaccccaaccccactgtgtgaaggacagggtgccaggggtcttctcttggctattgggctatttatttctccaaatgttagtgtatctgttcagttattaaattagcgttcattattaagagtcttcttatagattaaaagtcttatagtactttgcataatctcaaatttttttgtcaggctccttgtttgaaatgtagcttactaaaattttttttttatcaggctccttgtttgaaatgtaacttactaaatgtcagtgtcatgtgtactctccgttggcatgaataagagcatttaagaaggatgagcttgaggatctgcaaaggcagaagcatcctatgagcatggtggatttctctcacacagtgaatttcaaccctgaaaatgagtgacagaaatgcacaggagctagtttggccatctcttttcaggagcagctagtgattttttttttttaatttaaaaaatagcattatctttggacttgattttctttccaccagcaactgcttcagcaatatgtggcaagtaatgcttagacatggccattttagtttctttctgaaatgtgtgaactcccttccttatggatcttgtcttaaccagaggtcaaaagaaaaactgtgccaactcatcccttagattacccatgcactaatctctttttaatataataaatttaggtgcttgggagaaattctccctttagggggcttagaatagtaaggcaaaagatattaagtaggctttttggcattcctagagctgggctaattaggtttcctgcttccccgcccagtaaacctgctgcttcatttctgtattttctgtgagcagccactgcaatccgtgccagactcttcggttaaggtgggatttatgctgttgtttatgcatatgttcactgtgcagccactttgtcttctgacctcaaagtggttgaaagattgacatctccatgaaaacaggacacattaagtaactctcctacatgacacttaacaaccaagcatgtctccagtcaccccggacagcatggtccccaagcgttttagaggcacattaagatgaaatgtggacaaagtaaatagagctcttcagatgcataaattgaaaatgataatgattgctgtcactttgtgatggaagattatggatttcataatttgtggattcttcctaatgagaagcagattaacttttctcactgaatcaaaaatcccaatggcccaaatatccactgctgaaaagaagctatgtgctacaactggaagtagaattttgccatgatcctgcctcatatatgattgactataccattaccaaaagaatactgccagaaagtctaaggttttgaaattctgaagttttctacgttagccttagaagtttgggcagaatgattagattattttgaataatctagaaatattacataatgtttaaaatgatagtttactcatggtgtcatggatgtctttcttgtttataatgataacaataagataactttggtttaatttaatgaaaagaggaaagggaaagaggaccaggcattatattaagcgctttatgtattcattggtgtgaccctcttaatgattctgtggagatgattatcccacttttactatttagaaaaccaaaactctagagagattaaatgactttcccagggtaaatgcagctagtgagtgagtgagccagaattcaaacccagggccactggctcctcagccagtgtgactctccctcatcactgtgtccctgtggataaagatactggggcatagcccttattcctaaaaaagctttaaatccagagtcaaggaggaaggacctagagggtctctgctgagcagtgggcttattgtagtaaggacaattttatctttgccggtgacttcagaaatttggtaaaatgcaaatctgtgcatgccgtggcgcatctgctcatgaaactatgactcggtgtatgtaataggaagaagcccgtgaactcataggaaaagaaattaaacttgtatgtctgagctctggacttggaatcacaagccctaagatctagacctagctctgccactgactagcaatgtgaccatgggcaagtctttcagtctctgggtcttctattttcccatgtgaaaaatgatggggtcgggttagattcctaggatgcgtttcactctaaccccactgcacagtttaatactacaaattatgctaagtcatgacagtttggggtggggagagcaaataacttgcttctgagtggtaccttgatttatcttttcagttgctcagagccattgggaaacttaattttcatatgtattattagtgactaaaaataattagcattgctccttacatttaaaaaaatcttaaaactgtgttaatgaaatcttcctagcatgtttgaaagatgtagatggtttatagtgcccctattttagaattgagtaaaaggaatctaatactaccagtgagaggtacatttcccataatctcagagatggattggaaatggactccgggtctgctggctcacagtgtagtactttctcctctgaacacagttttttaaagcaaatttccagtttctagcagcctctgaaatttctattccttcacactttgtttttcttttataattctgccaccatatcttcacacttgtagaaacacatctgttgatataatcttagcactttctttgttagaggtggctagaataagaaatagaactactgaattatatcaaaacttcattataaaaatctggcatgttagttaccctttaacctcaaatacaaatattgtttataggcagcgtatgtgtcttcacaaagaagaaagaaaaagtggcattcatggtaaaataaactagaaaattaggcagagagcccaggaaacaacagagataagaacaaatatctgagattcttgttaataaatatgactccgtgtcaaaaaatatctgatattaaaagactttaaaatcaacagaagaaactattttaccttgtatccaaaatacagttattgtgaatccccacttgctacccttactcattcaagaaacgtgtaaaagtgtctattatatgacagcactggatatactatagtgaaccaaacagtgttcctgccctcatagaggttacagcctatgcagagataaacattcaacaaataatcatgcaaataaactcatacttacaagttgtgttaaagtgctatgaacaaagaatagagagatgaaataaaacagatggacaattgctaagtttaatatttgtctacagcagtaatcgagtgataaacatagtcattaaaatgccctttcctcaattctcgcatctctgtagtgtttgactgtcgattattcccccacttcacctccccaccttctggaaaccttcccctcctctgttgttttgtgccttgacccatcacaggtacccacttagaattcacttagtggcgatggctatagagcacctcctttctgtgcatcctcagcttcatctgccccttgcctacaggcattcccccaggtctgatccttagccagcttcttttacctctccactcacttagggaaaacttctctgcagctaactgccgatcctgtgggtcttcagccaacacctctcacctgctgagcagcagcatctcaacctggatttcctcccgttcagatgtaaagtgagccgtccttccccctttcctctgtcacttcccaccattccccagaccagctcttctctcctgacttgtctgtttttgtaaagtctgtttcagaatggctcaagtttgaaaccttcaaattagcctgtcttctctctctttgtgcccttttacatctcagtaatcgtgaagttctatagattttatccctggagcggacagagaagacatcttattttttccattcttattccctccatgctttgttctgggagtggttgcttctcacctgggttgctcccaaaggaaggcacagctctaatcatatcgcttcctcatacctttgcagacttttcattgcctgttgaaataggtccagacgtttactctggaatgaaaggtcctctctgacttctcctcaacttctcttccaggtttagcaccctcagagtcctaagcctacctgcacagcaccactggctacatgggggtccttggacaattattttaaactctcagacctttagtttcttcatgtataacattagaaaaatgactagataaaatatctttgtgattgctgctaggcctatcattccatacatatttttcttatgattctctgagtgtaggtgtggtctgtcatactgctgtttcttgtacccgaaatcccctgtgttaggctgcttattttcaaagcctggttcaaatgctatttcgtcttccttgagaccttttcagtcccttccatacaaatgtgacctcactgtcttgaaatcccacaccttctaacatatatccatgccttctaacatatatcagagttgctatgttcttttcttttttccccagtagtaagctctctgaaggcagtggcaatatcttatttcatctttgaatccctagctgctaacaagtttctggtacttaatagttgcttgataaatatttaattgatgaataaaattatctttaaattttggagactcttcaccaaaaaagatgtgcaaaagatgtatactccacaaatgtatactttacgatgtaaagtttcacttcaagcccataacctcgatagactggattttgtgtttttataattcatgtaggatggatcaagctacatatctcagggaccgaaatcaagcccaaaactgtactttcaatggattacatctatgaaaactaacttgtttagctttaagtttcaatgaacatgagaatattagtgaaagatgacacaaaacaataaagcaatttatatttccaatgtagcatgtctgaaacctatcatagagatcttctgttttcatgatttgaacactgatttattccttggatagtaatttttttaactattttatttaagtttgaaagagcccaactcaattctaccctttatgaccagaaaaataaattactttgaatcttatggaaatgtccacatattagttatactcaggacagataacctcacaaaagataactggcaaataaaaagcatcaattgttggtgtagtcattaaaacatactgtttggaagaccaggcacggtagctcatgcctgtaatcccagcactttgggaggccgaggcaggtggatcacctgaggtcagaattcaggactagcctggccaacatagtgaaatcccgtctctactaaaaatacaaaaattagccaggcgtggtggcagatgcccgtaatcccagctactggggaggctgaggcaggagaaacgcttgaacccagcaggcagaggttgcagtaaaccgagatcgtgccattgcactccagcctgggcaacaagagcgaagctccatctcaaaaaaaaaaaaaaaaaaaaaagccatacatactgttcgttgtgaatctattctttgcaccatgctgtcctttgagttactgtaaccctatagggcagcagtccccaaccttttggcaccagggacgggtttcgtggaagacaattttccacagacctgggggtcagtggcaggggtgatggttttgggattaaactgttgcactacaggtcatcaggcattagttacattctcacaaagagtttgcagcctagatccctcacatgcgcagttcacaatagggttcgtgctcctttgagaatctaatgcctccgctgatccgacaggaggcggagctcaggctgtgatgttcactcacacccacccattgcacaacttctgctgtgagtgctgtgaggcccggttctcaataggctacaggctggtacatgtatgcagcctggggttgggagcccttgctgtgaggtatatgcagttgacccttgaacaacatgggtttgaactgtgtgggctcatttatatgcagattttcttctgtctctgccaccctgagacaccaagaccagcctctccttttccttctcctcctccttctctgcttactcaaaaatgaagacaattaggataaaaatctttataatgatctatttccacttaatgaatagtaaatatattttctcttctttatgattttcttaataacattttcctttttctagcttactttattgtaataatacaatatataacatatacaacatacaaaatacgtgttaatcaactgtttagattattggcaaggcttctgataaaaaataggctattagtagttaagttctggaggagtgaaaagttatacagggactttaaactgcacagggggttggcactccaacccccattttattcaaaggtcaactgtgttatcacttttcttttatatatgagaaaaatgaaccatggatattaagtaacttgcctacagtcacatagtaaataattatggagtcagaatttaaaaccagaaaacttttacatcaaaatgctctttataaatgtttttgttttgttttgttttttcatttcttagctatgagtaaagaccattagctgtttgtgttttgaggacagcacaagctttttcttttactgaccagtgtcactgtaaaatgacatggtgatggtccttccatttcagacttttaaatatatctttccgtcacttttgtgagaaattgattaatatgtaaaggaaacaaaagaaaataaggatgagaagcttaaagaatagtgaaaatggctaattaaacatgctgcagaaaagagtcaactttaaaagttaattcaaatactttaaagactgaccaattagaaacaaactcacatgacaaatcaggattcatggaaatgaaaaatgagaccactagcactgaaacgtgaccaacacatttttcttttcttttttcttctttcccacctgccacctctttctggtatttctggaattcactgttaataattactgtgctcaaagagaaaaacaggaaaaaattaaaactcaacaagacaacttacaaaaccaaagaggaaaatcaaaatgtgttgcaatacccaagctgcctttgaagcaacaaaacaacaaagcaagaatgttgtgggtgtgaatacaatgttatgggtcaactattgtgaaagacagtatggtaattcctcaaagatttagaactggaaataccatttaacccagcaatcccattgctgagtgtttacgcaaaggaatataaataattctattataaagatacatgcacgcatatgttcattgcagcactgttcacaatagcaaagacaaagaccaaaatgcccatcaatgatagcctggataaagaaaatgtggtggtatatatacaccatggagtactatacagccataaaaaggaatgagatcatgtcctttgcagggacatggatgaagctgaaagccattatcctgagcaaactaacacaggaagagaaagccaaatactgcatgttcttatttctaactgggagctgaacaatgagaacacatggaaatagtgaggggaacaacatacactggagcctgtcgggggagagaggggttgtggagagagcattaggaaaaatagctaatgcatgctgggcttaaaacctaggtgatgggttgataggttcagcaaaccaccatggcacacgtttacctatgtaacaaacctgcacatctgcacatggacctcggaacttaaaataaaataaatgttaagggtaagtttgtgaggtcctccatttttttttatgatagctgacaccatggtttatataaaactgccaattggtaaaaaaaattacttttaattggttatgaattaaatagtcctactttacataggtttgggagaatttaacagaagtttgctgccttcattacctcgggctgctataataaaatattagagtctcggtgacttaaacaacaaacatttgtttctcacagttctggaggctgggaagtccaagatcaagatgcctggacaatttggtgtctggtaagggcccttttcctggtttgcagatgatcacctatagctgtatcctcacatggcagagaaaaagagctctgatttcttcttataagggcactaatctcatcctgaagctccactctcttgcccttatctaaacctaattagtcctccccaaaaaccccccacctccaaataccattatattagggattagtgcttcaatgtatgaatttggtagaaggtggggcacaaacattcaggccatagcaggcttcttctgtagttaaaaagaatggaagggttctgagtctcagaatgactagaaccaaggtgtctggatctctcaagcagggagcgagagatccagagaccttggttgtagtccctgctcatattacccctccctcatatttattgtaacatgttgcaaaacctaaccagaaaaagaaaataatataattcacctcttaccagcaggcagtactgcacaattctgccacacagagcccagaaaaggcaggcagaagggaactccctagatccagaaaggaaaattaagtgacttgagaaaatatgtaaaggctaagactgggtaagtggccctgcaaattccttctagtcacagaaacatttttctgggggtcacctcatagggccagtggtccgtcagcaaatccagaagtatgttcaagttttgatcaaaactccatgttatactgatagctggtttaatctcgggtcctcccacagactgtttaatggtgccatagtatctaccaaaggcatttttgagtatggatgtccccttactcttaatggaagtcctggtggaggagcaagtgccagcagtaaaaatgtaattctataaaaggtaaatgttgattacaattatattaactccttaagaccacagtgatctttctctaagagcttgtagggaaaaagttaatggccctctgaaaagagagtaattcatttccttttatccactttataatttgcaaatttgcaaatgagcatagcccatgcaagttgagcaggcttctctcactgatgggtagcatatccaaagctttcatgcaggtaaaagcactggaaaaaatatgagagagttcatcttcttccttaggagctgggactgaaactggtccacaggacttcagggaggtggtttgaggaatcctacatggtccctgggatcatcatttagaagctttgagggaataaagattcttgttctctgaacctgctgtctgatataatttgaattgaaccttgaagcccctaaaaatctggatgcagtgaccatacattcagttccatttattcaacaagccaggcaaggatcatcaaatcaataacatgactgtgccatctgccttccctttgctcaccatcacaatgaaaaatgactccttaagtgttctgcaaggcaattaactctgaaggcagagctgtaatggagagaggctgagttacatttgtattcagaactttactggtaaaatggaaaggaagctgttgtccatattaatagatacataaaatagatacataaaaaaaaatgtataaatgggataatttggtattactctatttatgcataatattatacaactgcagaaacacagagctaggaagggcactgaaatgacatatggctcctccaactgcatgcagccacagctggtgaccctgtccagaatcatcttggacagacagactgtttctaaagacattcccaaaagtcatgctgataacttccgggactaattcattctgttatttaacagtcttcactgcaatttgattccattttcttttgttctctttcttcttgttctcatctctctagaaatagagaacagctaattatgctccctataataatccatcatgtggtagaaggcagttttgaaatcaccacccagccttcagttcaggttcaatacagcactcccagtccttccatctgggcctttgaagagcctggctcctagcctgagtcatctggtgactctcagaatgctcttcaaccttcccaaatattattgattcaagagacatgaaatacaaagggactctgtatttctgtttgttctggtaccctctgcaggtaccattgcctctgcctagattgtcctacccatcagcccctctccgatatacacacctccccttttgcaccaagagaatttcgaattcaaaggtcacctctttcatgaaactagtccccatgtttacccatcctcagtcctctgctttgctttttcatttactattataaaatttttcttacgctgtctccgtcccacccaggcgagctaagggcagggatgtttcccttattatttctgtaggggctaaattgtgcctacaacatagtaaaagacaatttgcttaattatttcccccacttttcttacctgtgcatgttggtgctaatgtcccagagtccaactcttaagctagctgtaaattcacactttctactgccctttgtcatgtaccttgctataaattaattatagatgcttctcaggttttaaaaatgataaaccaccctaatctctggcctgaaatttggcttatgaaaactttattgaggttaaatcagttccttactactaactaggcctgttgtctcagccccatccttgtgacctatttgtctcaagtcttagtagtcatttcgcaatacatgattttttctatgtttaacaaatttgtttcggtcttttgttatttttttccagatataaaaatatcactttgatactctggtcattcataagatcattgtttgatcatttttaacaccattctttttccttttctcaaaaatgaggccaggagcagtagctcacacctgtaatctcagtgctttgagaggccaaggtatgaggatcgcttgaggccaggagtctgagacaaacccaggcaacatagtgagacccccatctctacaaaaattagaaaagaaaaaaaaataatgtttcatagattctttattctcagtgctttaagcaggatcagagcccttaccacttttcttgatgacctgggtatgactcaccagactctgcttctgctccttggaccatccatttatagtttctgctgactcttgctaggctacctggctcctgtatcctttgttgtggatttttagatcacagttgttctttaagactgaaatttttcaagcactttgaaagtctctttttaaagcattatttgttattagtattttctgttacatataaaaacaagccaaatttttaaacttattgcctactgcattacaggttatattctgtttccctttatgtttccagtggatcactttagtcctcgctttattgcttttcaccttccctgatgcttcagaatcatcatgttttgtcagcttcttaggtgacttatagtcttgtcacagcactcctaagttccattttagctctttgtgcagctcttgcctgtccacttgaacttcccctcagccaacttttttcatatgcattaaaagtatttctcagaaatgcaaattaaaacactactgaaatactatttcttacctcttatgttggtgaaatttaaaaagtgtggcaacctagtgctgggaagaatgcaagctggtacaacaaccgtgttggaggggaatttgacaagacctaacacagctacacttgtactcttttgacccagcagtcccacttctaggaatttaccctaaaatacacctccagcaatatgaaactacatatgcatgagttatttattttagtacttttttgtaatcacaaaatgttggaaataacctgaatgaccatacatagggaagcagtaaaatgaatttggtacatgcataaatggaatacactgtacctgtaagaaagaacaaggaagaccttgagaaactcatatgaaattatttccaaaatatattaagtgagaaaagtaaagtgcatacagatatctagagtgtctgtccctaaagtaagaaatagggactataaggaaatctacaaacgtctactcatttttgcaaaagatgtaaagaaagataagtcagaaaccaacaagactgtttacctacaggaaataaagcgaaatggggtataaaaatggagcaatgagagggggagttggagggacacttctctgagtacacttttgtatataactctgacccttagaaaaaacctgacctttcacctacccaatcagttaggatgtgggagaacccaaaatgaaatacgaactgtaaaaaatgaacctaaatgtattcaaatgaataaataactatgctgggggtatagggaagaaaagagcaacctaagtacctttagaaaatgattattttgactatatactgtaacaccaaaagcaaccaaaaatatatatatgaatgtactatagttgtatatttgtttcttctacaaacaggagcatggaccagcaattctgacactatttaatgtccatgctaggattgaacaaagtaaatattttctgggtaatgagagctagttttctcactgtcagagaaaaatgatacatatgaggaaagtgagaagactagaatgaaccctgtggcattgggttggaattagagggatcagtatgagtttattcactgtaggtggatgcacatagaaatatagatgtatgcacgtgtgttggtatacaattgtatgtttcttaatgctgcctgctgagaggtcctagaagcaatgatatctcagtagcaataaatgtacttagcactcatctcttggttttttaacaccattctccaataaaatgaacaaggacttttgggtatatggttgattccagggctaagaagggccaaccacaagataagcttggaatatctaatggttccagaaaataagtactcaaaaaattgtgaagacatgttaaaaggacttaggagccaacctgaaggagcagctaatggccaaagttggaacaactcgaacaaagtaaataagtatagtattggattattactcaataaatgtatgatccatgagtccacactgaaagattgaatagataaagaatagatagttcgagaccagcccggtcaatatgataaaaacctgtctccacaaaaaatacaaaaattagccagccatggtggcatgtgcctatagttccagctattcaagaggctgaggtgggaggatcgcttgatcccatgagattgaggctgcagtaagctgagattgcaccactgcactccagcctcggagcctgggtaacagagtgagacccagtgtcacaagaaaaaaaaaaaaaaagaagtgggagagaagagagcagtggtttcttatagtagaattctaattaatggatgtagaaataagggaaatagaaaaatcaccattagacaaataccacagtagtaattgttaaaggtaagaaccattgatgaaatctaaagttaataggacaaaacacattgtaaaacaacacatttgtatagtcagagtatcttcccacaagacatttattgattacaaaggggaaagcagtaaatttgtaataaagaaccctagcagacatgacttatccaaatgatcaaggtcaatatagctagtaattaaacatatagaaatcatatgcctgctgacatgttgcatggagaagagcaaaatatcacttctgtggtattcttcttaaatgtgtaacaccaatgtaatcacaagaaaagaggccgggcgcggtggctcacgcctgtaatcccagcactttgggaggccgaggtgggcggatcacaaggtcgggagatcgagaccatcccggctaacacgatgaaaccccgtctctatgaaaaatacaaaaaattagccaggcgtggtggcaggtgcctgtagtcccagctacttgggaggctgaggcaggagaatggcgtgaacccaggaggcggagcttgcagtgagccgagatggtgccattgcactccagcctgggcgacagagcgagactccgtctaaaaaaaaaaaaaaaagaaaagaccagacaaatccaaattgagggacagtttacaaaacaaaaccaccaaaactcttcaaaagtgccaaggtcataaaagacaaagaaagactgaggaaataatacattggagtctaataacatatacacgcaataaaatcctgcattaaatcctggaccaaaaataatatataactgagaaaactggtaaaattcaaatagggtttgttgattactcaataatagtatattaatgttgattttccagtgttaatcattgtactctggttatgtaaaatgttttcatttggggaagctgaatgaagagcaaatgagatctctgtactcatttgcagtgttcctgcatgtctaaatttatctcaaagtaaaaagctaatagaagtattttgtcaggactcttttataagttggtcatattccaaagttcaatctatagtttacaggctctattttgtcatagaaatcatatttatttcattatatggttcctgggccagcctcaaaagcttacttaacctacaatttttatatatgtatgtgtatctctatttattaagtagtctcactgtattcttgaacataacatagtatagccatgttcccattatagaaaaatacccctatcttacaggtaaagaaatgaggttacagaaaggtttctttacttgccccacattttttattttaagattttagagcaagcaagttgcagacctgattttagagccaggtctgtgtgacgccgtatgctgagtttccctgctgaggtatctgaggctttgtctgctaggccactcactcacacattagctgctgaaaaggggcaaatcttatggacacttctgtgctgtcctctggaatctttcccttgattctttttcttttcctggattgttgaacaaaatgttcatgtttattttgttcatgagaattgccttgtttttagaaatagtgacttttaaatagtttgtggattttttttctctaattctgcctatcattttaaaaccatgttttatagataaatcaaaaagtgtagaactcctaatgcagcatttggagcaaagttaataaaattttaaaacaagaggatatatatttactaaattacactgtgcttataatgtgctgccatatttttgttaaaattttttaatgctttagataattaagcatctcaagactataatattaggctaagaagctctttcccattaaaatattcataaattatgttgacacgaacatggtgttctgaacaattataaggagtggggctcctaatgcaaatgtcattcctattatgactttttctgaacttagaaaatacattcaagtagtctatggaactgtccaaaagatacacagaaaccaaaaccaaaacaaacaaaaaccaccatttatcaggtacttactgtgattcagtcactatcataaaagtattttcttatgttttctcatttaatcttgcagtaactctgtaaggtagatactactgtgtctatttgacaaattagcaaaatcaaagttcaaaaacctaccagtagttagagagttcataattgacaggaccaagatatgaacctagtttttgtgtctactctacagtttatgcctttaatccttgtacagtactctagtgtttcctgacaggaaagcattaaatacagcatagaaaactaagaaggaaaaatggcaccaacatgaaatatgttaagcttatatttaatctgctgttttatgggagttttttttaaaggagcgagaagaaaagctacaagggattttaaagagtaattcaaagatcaaacatgatttttatcttttgtcccagagcacttcagattcaaacccaaggcttcaccgctgctgatgcacatccgcctctgagtctcgtaattggtaaatttacatcatgtgtgtcaccagcagcttaagaagggaacagatgtcagttttaggaaatcctgtgaatttcaggcttgctcagactaattggtccaattgataaaatgctaatgagaaagtaaattcaaacctttaccataataagtctgaattctgaccagtaaagatgaatgtaactgcctttctgaaattcctatttttcacagagtaaaaaacatatttttttctttaaaaaaataaagccatatttgtcctttaagaaagtgttaatgttgagctggtaatgtaagaattacctagaaattttaattgaaaatattaactgttttatacaattaaattcattttttggatttctttttttagagcaatagaattccatgctgtcacttgttagatttaatgtcatcttgataacacatctaggaataccaagcaactaactgcttaagcattaacgttttttccatgtcatataataagaggaagtttccatttacttataccatctttaatagaaaagaatggtacaagtcaaggtcaaagtctccttactggaagcagcagcctggcaggctgcttaggggtcctcatatgctttttcctctcactgaagtagtcctctttcctctcttccaagttcagtgtcattagcataacaggatcagacaactagagttcatcttgttcagccctctgtcttgtgccgcttccatcttatattttttaacatagccacagattgggaacacacagtttctcacagtaataattccacatcttatttccttttagtgtttggaatgtggccaccctgtgaatttttttttttttttttaattttttgagacaaagtctcactctgtcgcccaggctggagtgcagtggcacgatcttggctcactgcaacctccacctcccggttcaagtgattctcctgcctcagcctttcaaatagctgggatcacaggcatgtgccaccactcccagctatttattttttaatttaatttaatttaatttttttgtattttagtagtgatggggttttgccatgttggtgaggctggtctcgaactcctggcctcaagctatccatctgcctcagcctcccaaagtgctgggattacaggcttaagccaccatgcccagcccatgatgtgacttttatacaaacatagagcttatacattgaattggttgctgcccttttcaagactgttaccttggaaggtcaaatgtatatattcgagtgatatgcatcttagtattttaggtaagagaagactctgggagttacaacttattctagctcctttgccttctctttcatcttcttccaaaatttcttacattaccatctattattgccatcttcatttattccctagcccattgtaatctgacttcagtactcacttctgtattaaaactctcaccaatgaggttacccgtgaccgccaagtctcttaatagggacaattgggtgcactctcattttctccaacccactcattaccctaagagttatcatctgcctccttaactaaactaagagcagcatggaggcgagggccatctttctttatcacagtatcctctatgtccagcacacacctgatatcacagaccgtcaatgcttcactgaatgaatgaatgaatgcatactctctgcctctcattttacacacagagacacagaagccctaaagaaggcatgcagttcgcccagggtcatacagctgattattaggagaaccagcatgtgacctcaggtctcctaactcccaggccaatgccaatgggtttcatataatactgatgtggctcaaaagaggtttcggctccttttaaattgttttcaaagcccacaatatattcttttgaatatatctggtggcaagtctttattctttttttttttttttttttttttttgagacggagtctcgctctgtcgcccaggctggagtgcagtggcgcgatctcggctcactgcaagctccgcctcccaggttcacgccattctcctgcctcagccgcccgagtagctgggagtacaggcgcccgccaccacgcccggctaattttttgtatttttagtagagacggggtttcaccatgttggccaggattgtcttgatctcctgacctcgtgatccgcccgcctcggcctcccaaagtgctgggattacaggcgtgagccaccgcagccggccaagtctttattcttttaattggtggcttttatttttggaattatcctaaagctaccaggacacacaacgtgtttcacaacctataaggcattacaaaatctgcaaaggggtattaaaagagctgtccagtctacttttagcctaaagaatttaaggcctcatagtgggagcatgattagccagagcaatttgcataaaaatatacaatgggaggctttgactctgttctcatctgtagtagccaggaatccccaacattagtgggaaagagctaggctccttgggcagtcagatatttgtctacatgtgtgtgcctgtgagtgcatgcctgcatgcacaggtgctgtggacaggggaggtggaagaggggccaggggtgttgggatattccttctgggaaaggaggactcatttctcttctactgttcatttccactcatctcccaccaccacacacaaacatatgctagtctcccccgtagctcatggctatttatgttttataggttgattttctgattataaaattaatgttttcattgtttaaaatttaggaaacagaaacaaaaatcttacaaccccgagataaccaataaaacacatattttattcaggactttagacatatttggatttctttttacataagcggcatcattttttaatgaagttctgtattctgcatttttgctgaatgttataaaatgagtatttctccatgtcattaaaaattattcagcaatataattttaatgactgcatattgctttttatggatgtatcataaacttcctaattattctcctcttcttgggtatttatgttgttcccagaccttttttttttttttttttttttttttttggtgttataaataacgccatgaaaaagatttctgggtaaaacttttgtccacatctctggttatttccttgggacacattacttgttctgaagctagtatgtatgaaccatacttaggtttatcaatacatattgctaaattgtttttcaggaaaattttaccaacttttctcagccaactgaggtattttgaatatcacaaaaaagtaaattatggtaaatggccatactctctccctaaggaaaatggcagtgggacatagcaaggcagtcagattttccaaatcaaggggttgatcacaattgactagctattggctcctgcctttggcaaaccagaagcctggcagaggcctaatagaggaagagtctagcagaaatcatctgaaattaagataaggccatccttttgcatatgaagggccaggtagcaaagtataccaatatgtagctagtgcttttggaatatgcagtttattatttgacacatacctgcatcctaaaagcatttgaggtaagcactggttatctgggacccaactgctcctgaaggactaacccctgaactccccagcctgcataactaagtaaccagattccaaagcagagattattatcctcatattcagtgtgacctaaccaatccatcttgacattatttctgataatatcgtgcatatctttatatatcaatcaaggttttatgaaacgcagtaaaacattaaaatggctaagagcatagactctggagccagactgtctgagatttaattcctagctctacaatttagtagctgtgtgatcttaggcaagttacttaatctatctgtgccttagttttctcatcataatttgaagataataatagttcttttctttatagttgtcatgaagagtaagtgagttaaaacatataaatttctaggaacaatatcaggcccatagtaaatgctatatacaaatttcctactattattatttcgagttgctaagaattaactttagcagaggaagtaacattagataacacaaatattttaaagcaattgcttgagttttgggaataaaaggaatgctttttttcaactaggatcccaataatatttcggttctgtccttgaaaagtttttcttttttttatcatgattgtactcagtaaacttttggatctctcagacatatttgaaagcagtgtcttatactggggacaaggaccattagcattaccacccatctgatactttcccctttacactaaggcattattcccataatcttacaaatttcccataatcttacaacccagatataacaatgacaatgacaacaaaaggcatatttccttttaggacttttttttttttgccatagcctttctcttagattcatctggataaatctcactgataggttgaggttatcagagtgtgtctagaatttgacagtaccggtcctagaaaggcctggtcagattctttgtgtgtgtgtatatatatatatatatatatatatgacttttgacaatgaaccatttgaaatctaattccactgcatgatccagatgaataaataagctaaatgaaaagcatccaaggaaaggaactactcaaagaagcaggaactgcttgagcagcagaaattgacatgaccatggacatgagggtctataaactctgggctatcatggataattgaaagtcataattttccaaagggcttaattgaatatttgaaaatttgtatgaaaataaactgagtcaactaaataataataaacacagctaaactaaacaatataaatcttcaaaagaagaaccctaattaaaaagatagattgcacttcctggactttgccattctggttgttttcaatattatgccactgggaaaatacaactgtttctaatcaaataatttaaactcccatgctggggcttaagtgtgtgttctcccatttttctcttgctacttgttttggggataaagcagctcaaattattcagacaccaatcagatttatcatcctgtgccttttgatgacatccatctgtttatctaagaagccattaaagacttattgagttacagtgctatggagaaaattgggttatcatctatggttaaatccaattcttgcatctgccatcttttcagcttatgtggtatattctgaaattaccgggacttgcagacctgcactacaagaatacatttgcttcctagcctttctatgtcatttctagagaatttctaatgtatgcacaatttgtggttcaggaatatgttgacagaaagatgtcagtgctttctgttgttaaaagttcaaaagcctaatagagactatgccagcttaaaagtcttattcagaagtgggtactgtccaattccaacgtttgtgtttagactagcctattcaaaggaaaatttgactctaggtcacaaaggtagaagtgtgttaatcagaagataaagataaattaatatcaagtcaaaattcaaacggacaaaaaaagtgagagctcatcacaaaaggtgttaaataaacaccagcaagtaaactgataagacacaaaggatccaatcttgctagggaatgactaggtagaagtccagtgcttatctcacaagtcaagcagcttaagcaaggctaaaagtcatgttttctgagctggtgaagaagcagtggactgtgtggagaaaactaattgaaataaagtgaatatttgcagtttccgggagatactgttatatcctgactgcaggagccccagagaaagagcaactgtaaatcaggcagatgcttcagtttgccaatttttctagcatttgtcagagaaataatgaggaacccatcaggaaaacatttccttgatttgtttatgtaaatcaggccagaattctgggaaacccaggttttctgggaatcttcaagaattacagcatagctgctcctcctgaaattctagctgaacacactatttattgagcatttaagaagatctttccgatcatatttcagtttcctttctttgttttcctcatagtaaggtaagtaccctgaaatgggagacgatagccgtgcgatagctgagcataatcagttgagatctacatgccagatatggctggtttcagaaagatattcatttgtctgtctacctgtttgcttcctgtgaccttcatataacttctacctgtactgtcagcagagatgctgtttttgtgtcactggtgatgccacagtgaaagaaaaatcttgccaaggcaaggatgacaaggaaccaggacctagaccctaaagtagcaaatattgtggggaagagtctcctgggagtactctttcacaacctactaaattcatccaaaagtaaattttagtaggattgaaaaatactcagcctcttgttcagagtgagaagctatatactgtatgattttaagagttatgcctttttgtctttaccaccctagtcaacgcacaaaatacttgctctaacttgctgaaattctatgattaacaattcatttatttgtcttaagctttgttaaccttttaacatataggtatatgtagattatctgaccctttctttaaggtagtttctggctgcagaaagggaggagtgaggaccctttgggccagaaggagaagacacctcgtttctccaaagcttttgtctgtgatttactgtattgattgactatttaggttagcattttgattttcagtcaaaacggcagagggaaatatattggccacttttcagtcatttattcaaagaccaatgagactgagacaatacctgtggactattctctaatattttattgagtgactttattaattttagtgtttagataggagaaatgatattgagaattctctaagaaggctttcaataattgcatcgatcagttaaaggtgttgatccagatgcaaataactgctggaatggctaatgacaaggttctggaaatgtactaggaattactcaagacagaaggtctgagaggatcaaaattggtatccagaaatggcaccaccactctcccctctttcactgtttccatcttcatgtctcctccacagctcttcatgcttgtcaacttggggaaagtcatggttgatgcccttctgacagcctgctggagaagatctgttgccttttctggcagtcagtgacgtcttctgccacaactgggctttactctatggctttcttagaaagcagcatccatagctggaggagccttgagctcactggactgagtcctttcagcttgaagctgacctccctgattgccctgcctctccattgcagtttccgttctcacactgaccaatactaattgaaggagatagcatcacctactggtaatcaggtccctgccttgtcttaggttgccatccaataacaacttgagaatttataaaatattgtttttctttacaggtgtttcttgagtttgtttctcaagtactaagcactatcagagaaagaaatcaatgttaattatacacaaactgtaggaatacaaaagaacatttagataatcacttctctgaaggaaactacaatctcttcaggcagataatagataatatgggtatcttccatttctacaaaagataaaaatgtaggtgagagagaaagagcacttactaaaagttaaatggagtcagcagaacctgagatttccaagtgatagaaacctggacaggcagcagaggtggagaagcacagtctaagtggagagtcacatgagcaaaggagactcagaaatcagagttctttggaagtgggaggttgctaagaaagatcgaaaatgccaggaaggcccttacttccaagatgagcttgaatttgatctggtaggaattgggaaaccattttggatttctgagcagggatccaagctttaaatgcacagttttgaggacatttacttttctggagtatacaaactcagctgttaaagagtgggatcagaagctaaagatcagctaggaaaaattacagtaatccaggcaggtgagggtctagattgcagcagaaaaagagagtctctgatgaattcaaaagttattggaaagtggaaattgataggacttggtgacaaattgaattaaattgactaatcatttattattttgtgcatctcagcattctacatctctaccagtgaactcattaaagagatttttatgttaatagcgaagtttttaatgtaagttgatttgagagatcttttctggttgaatacagttggcaggctgttggatttagtaggcaaggccacatttatctggcatcattaaaattaggtaacctaaataaataaaatatttagacaattgaagcttgctgtcattgcccaatttggggaggcagtccagagggactggccagatcagataccattctgtggataagttatcctgagggacaagtggagaaacaaattcaggggcactttttctaagaacgggaaggggactcccaaagaaattccccaaactaagacatcagtctctgagacaaaatagaacatgaaatgaggatagagattcaaggatctaagtagtccattcattaatgaaataatattacttatgtgcattgagtacctacttccgtgctgaaagctttgcataggtcatttgttttacttgtatgtattgagcacttactaggtgttggctgagcaaagaacctaacaggtatgttcccagcccttatagagcttatagtctggtgtgggagatagtcatcaaacaaataattatacaaatacatacttagttacaaattgtgatcattgcagtaaagggaaatatagagtggcatggaggtaaaacaagggttctccacttagatttcacagtcaaaaatggtgttcctgagtaaataatattctagcagaaactttgaaggatgactgggaattagccaggcaaagactaaaaggatgagtgtcaaggacactgaaaggcaaagtaggagatcaaatactgggaatcttgaagtcggaagtaggtatttggtttaagctttggagcaaggtgaaactggaacctggaatggctgtaattacaaattgtcctcagattacccagctcagaatctacagacacacgctaaatgaaaaaggcagcatatttaatggtcagaacatcacaacatacaatttgcagtcagatgaatgtggaccacttcttgggtgttttatcctgggaagacacttaccctttctcagctttaatttttcattctgtacaatggggctaatactacttatctcttggggattgtgaaaggctcaaatgagataatgtctgtaatatacttaattcagtacctgacagacaatatatgctcttccttcatgtcaccaagtcttttgttattctatttaattcatatttattttgataacaacatgaagatacccacatacctagcaaaatgtaggaactttataacaggcattttctttgctgctcagaagcttatctgagtcttttccacctattccctgatctgtaattgtgtttcatatttttgaggctctctgaagtgaaatctccagattgggaaagggttaagggattcatatgtaaatagacatagaattcagtgtgtgctcaattaagatttgatgaatgaatgattactgtataattatagagatctgacagtgataaccatagttaattcattgctaaggtcgtgtacattgaaaaataattttaaagcattttttagtaatttgtgtttttaagttgttagtaaactaaattgcaaccttttgttctctgaatattctcttaactataaatctaccatgttttaatcagagaaatgttgtgacagttccaggaaaggaaacattttttctgtttaaaacatttctagcatttcagccaaacaatttatctagaatggttttccctttaaaaggaatagtagacaattagaagcatagtacagtacattttctgccttatggttccaagccaaaaaccagagaacttttgtgctttataagcaattgtaaactaaaatgagtaactggtatatggtaatagactaggctttgagctgctattaccatagaatacttttccggctttcttagaagcacgagaacaaaattgggaagaaggcatttatctgattgaagctaggatgctacttgcattgtacttcactttaggtagaaaggcagtcattttatttgctgttaatgtgaaaagagatatcacttctctttagaatgtagccagcaaatcagtatctaaagcctatacacatggctagaaacaaagctacccatatagccttagacctccctgaacctgatcaggccccaggatactgttctgctcatcacagtgggaagctacaggtttgctcaaaccaagtccatctatgggagttactaaaacctctccttagcacttctccagaatatggaagtttgggaaagcccactccagggggtccctacatatacctacataaaagcttcatttatttgtataaacaggcagatcagaaataggttagtgacaataaatgggtaaagtacactgatgtttaaatatttcccttgcaataatacctggatgagattattttatttggactttgggaacaaaagcattgtttggcaatatttaaatcctagtaaatataaacagtaagcaaattttacaattaatttaaatagttcagccaaccacataactatataaatcctatgttagtttaatctctctagggacttggcaatatttttttcttgataggcagatttcacatatattttattcatttattcaaaaatattaactaagtccaagaaaattcctaagcaccgtgctaggcactaatgccaaacggccctgcactaaatggacacttagagtcttgtgtgggattcagacaggaagcaaatagtgtctcagtattctctctgcagtatccttccctcttaagacgactcccagatcagaggggagcagctcctgtagaagtggcccagggctaggagacctgccactccccttctccccactgccctctcagcgctcctctgtagggctctgcagatctagtttgaagattgctttacatatggttctgatgtgcagaaaaatggaagaatctttgctgaatctatttcatttggactaaatctgtttcagatcttactggccagcctcaccatactggccacacacatgcaagaaaaagccttcattccaaccaacctaaagccacactatttgctcattacaatgaaagacataatttacttattgcatggcttaggccagagagaatgccagtaggaagactcttctcccaggaaataaatagattataagaaacaataagaaataaatagatgtggacaagaagcctcaatatgcttacctgtctacacacacacacacgttattgaacctgatgaagggttctgaacttgcagaataccagataattgacatatcagtgcatctctagtctgggtagattaatctggggtacaagtatattttctctgttttttatgttgttgttgtttctacaagcagtttccttttgcatttcctctgtgcaaaacaaggacctggggatctgcttcatttataattagagcaagaaagtcctgcttgacattgtattggagccttacagtttcaagactctcggttgcataatgcatgtgttttgttaataccgttaataccatgtaatactagtgcccctgatactgtgtataaatgaggcatacaagtagctccttcgcccagcagcaacatggtctgtacttgtagaaaaatttacctcctgaccccctaaatattgattgtttgattggagaattgagagattccagtggtagggatcagaaaagatgaaaaagatgaaaatgtgtaggcataaaaatagtatgaggaagagaaaaattataatggcatcacatatatgttgcatattctatgccaggtagtgttaaaaaggtttatgtatgtgcattcacatactcatttaaatattacagcacccccccaggggatacacatacttactgaaattttagtctgtgtaacatagcaagatcctgtttctactaaaaattacatttaaaaaaatagctgggcatggtgatacatgcctgtagtcccagctactcaagaggctgaagttagagaattgcttgagcccaggacctccatgttgcagtgaaccatgatcgtgccactgcagtccagcctgggtgacgtgcaactctctatctcaaaaaaaaaagaaagaaagaaagaaattttatagattggggaaaccaaagtaaaatgccttggccaagatgacatggcaaacaagtgacagagtgaggatttgaacccagacagtccagctgtcaagtcaatgctcaaagcatgatgctatgtagccataggagagccctatatgcaggtagaggaaagatttctttataaaccaaaagatgggtgtagactcagtgagtctgtataacggggtaaagggagttgtgagaaagggaaccgagaattttgaaaggaatagagggctgaactgaagctgaactggggaagcccctgactgtggtaaataaacagaaaataaaaacaatagtagtcacttagctgctttaaatcccctttttagcaatagattgtaaatgataatcactgtgagttttttttaagggaatactagagattctggtccaactgtggttcgagtggctgcaaggaaagcattttcaaccagcagcggaggctgcagtcattcacgagcatcaggaaatcaggggagcctcggagaggctgtgggtgatggatgggaacaagttgaaagaatagtatgcagaagcctggggtcagggtggggcagtaaaagctgagctcaggagccaggaaattgttcagaagctagaaatcaaaagtcatcagatggtaaaagccaacacagcagagatgatgccaaaagcacctggaaacaaggcaaaaacagcttcagacaggagaaagcagcttatattgctggactaggaactgaaattatttcccaggataaagtcatcctgctggaggctttcagtagagtgcttcacctcaactggcagtggctgtcagccaaggagaaacagatgcaatctgtagctctaactgaaaagcctgctgtcgcaaggacccagagatctgagacagtggggtcaacctgagcctggccatgggagagggtgaactatggagaaaagtgaaggaatcccaggcttcggctagagaagacctgtgataaatagaaaggggccaggtacggtggctcacgcctgtaatcctaacacttggagaggccaaggcaggtggatcacctggggtcaggagttcgagaccagcctggccaacatggtgaaacccagtctctactaataaaaattttaaaaattagccaggagtgctgatgggtacctgtaatctcagctacttgggaggctgaggagaatcgcttgaacccagtgggcggaggttgcagtgagccaagatctcaccactgcactccagcctgggcaacagagtgagactccatctcaaagacaaaaacaaaaaagaaagggagtggtactgtggaactggaagggcctggaagaatttgatggatgttgtagaacatctaggccaattgtgtccctgtcatttacctaatcagtattggatttttcatcctgagtcttttgtgcatgtacgagtagttaaaccctttatgctcttaagtatttatcttgctgcaatgtatggtaatcaatgaggtttgaaaggactgctttagaagagaaagagaggaagcaggtaatcataagagttgttttccccttgagaaaccaaaaagaacaagctctgaatagaggtgtgaggccccttcccactttaacattctgtgagtgtctgaatgtcctaatccccccggggtgaaaatgactcagaggcaggtggtacctactgtatttttgtggagctgtcctggggcctgtgccctcaatgcgtggcctgtcttttctgggacttcaggctctctctatgaagggctttccctgttttatgctcagggcattgcctagctaacatgagcctatctctgggtatttccactgagggtaggctgcgtatccagctatacatgggagtaccgtagttccagggccaccactagctttcattgcctttgagcaaatgctgtcctgctccagagtttatggcttggcacagagtggaatctgcatttcagccggtgcccagcccttagccaggagtcttgtgcagtgatgaactcgcacagccatttgcagtttgcagcgcccctatggattgcttctgtttctgccggatggtgatgaaggagtgctccaacacatcaactctgtagcacaatagctttcacccacaaagctttgtttcctatattctctctggcttacctaaccaaaatattgaagtcatctttgactcctccctcaacctttacattcagttaaatactagtgttgatcccacctctgatttctcaaagactatttctgtagttcaaaaaccaaaagaactaacattgacagagccctgccatatgctgggtactttaggtctcttttactcattataggctatcttcttcttccattatgttcatttcgtaaatgtggaaagcgagacttggagagtttcactatcatggcctcaagctagtaagtgctgcctacccaggtctgtctgcttctaaattccaagctcacctgccctgcattacactgtgctcatcaatctgctccaggacctaccattaaatagctttgccaaccccacacttgccctccaccagcctatcttccacactggtgctggaggtaactcccctaaatgcataccacctatcctgtcacctgcagatttttgaggaccagccatttctgacaggtaaagttcacccttcccagcctgtcatatgcagtctttacttatttccccagccttggttcctaacactcatgccccatctccaacaccatcagactgagaccaacacgtccaggccctggggataaatggtaaagggaagatgttgcaggattggcactcagcattcaaaaacagttgttgtctctggggaagagccacaaaaggccttgaataaacactgagagctgagcaaataagcacatgcattagaatgcctgcagggtgcccacactagttaggggtgtggcgggctttgggagaaaggctggtggtcaggtctgccccactgagggctgctgggaagatattcaccgaactgcctaaataagtggccttaagacgcccctaacccaggttctgacacccacattgtacttcctagtcacactgagttagttgttctttcccataggtaccctgtattttcatacttcattcacatgtgctatttcgtacttcattcacatgtgctattttttcagcctgtaagacttgctgtcatctggaaaaattttccactctccagggtcacacattattgtcatcttctctatgaagccttccagactccttgtaggcagtgttacaactctcctttgtggttttatagaggaagggagaatgttttggtaaggaaggggtctgagttggagaatgagaagaggatgaggagtagaatggcgtctcttccccgcagagctcttaggtctttgctcattctggtgcagtggcattagccactttgtatggtgaatagttttgtaaaatagacagatgtctacaggtacttcacccttgccatatagcaagcttttagtgctccctgcctcccaatgggccgccagttatttatggaaggaataaaccagttacaatacatcatagctccggctgtttgaactttctggctctagccatccttgcccatgttctctgcccataaagcctttacagatgcctcaccactgtcatggtctatcaggggaacagatgccagtagctatccaagctgcgacctcttgataatcccaaactcctgttctctaaggcaccagcgctgggcagggctttgcgcagatggtaggagtgcatcttctggaccctggacaactctatacccatccaagaacaacatccatgcaagaaactctttacccctcctgcacatccagtctgcaagctccaatggagaataagttatatttcttcccccactatccttcccactccatctaagacctgtcctcaataaaactctcttctattaggaaaacaaagctcttgtgcatatgagtgaatgagctacagctgttgggagtgaggacaatcctatctttagataaacaccccacagaaatgggtggatatgtgtaccaaaggacttatacaggaatgttcacagcagcataatttttgtagctaaaaactggaaacaatctaaataaccatcaataacaacatggataaatgaagtgtagtatattcatacatgggtatggtataccgtaatggaataaactactgctacatgcagcaatgcagatggatcctgtgtgcataaggttgagctaaaacacccagccacaaaagggtgtgaactatatggtttcatatgaagttttttaaaaggacaactaattaatagtgctgggagtcaggaggagagttatatttcaggaggagagagcagaggggatcttctagagctttggtatagaaagaactgatttaggggtgaacgttctgcctaaggcctgggccttctgcctgggtaagaatctctgaccagttcagaaatggcctacattcatcagatgcagaggcagtcttttcaaactgtccattcagcctgcagtgggggcatttggaatggatatgaagaatgacattttgagtagcttggtgtccactctgctcatgggacagaacctaatgattgattcagtaagtaaaattccaggaaagaattgcgtgcatttagatatgggcttctgtggcaacaatgctagagctgaggaaaaatggaacaagctgtcataaacaggcaaaagaaaatagcagtttccatctggaccttacctttacatggctgttttagccgtgatcattccaaaatgaatttgaaatcacattttacctcatttctctttatatctggcccaatatttcttttggtaatccatggctatgaagcccttataaacagaatcctggcctattttcaaggatgggagatatgacacaccaattaactctaggaaggtttgaatttagggtggttttatttcaccatgcagaatgtttaagccatatctcaacatagccagctactgcaaattccaatcccagaatcacattgctcccatagtggatcatctggctgtcaggagattctcagcaaacaacaacaacaacaaaaagcattaggccgcttcttcctaattatgtctctctctaaatatctaattatcattgagaacaaattgcatgttacagagataatattatggggaatcgttaatctgttgggcttctgcttttgaattcctgagtcggtactgcagctgctgaagcaaaaaattctgccacctggacacttcattatgatttcatatttaaatgcaaaaaaactgccgaagagaggttctatttgatggacttggcttcttcaggcatttcgtacttagctacgcatcacatgtacaggtcttccaaatatcccaggtacctgggaatagtgaataattgagcatttacagggacagaattacaagggaacaatgggaatatagtaataccaataaggtgacagtggaattgacttctctaattatactttctttttatccatgcacaaaggtctgcagctttttgtaacattcctcagtaactgcataggacttccttaataaatgctgatccaaaaagtacacattcccaaagattacctgataattgcacctaccataatatgcttaaagctaattaacattcagacttcactttagagaatagaaattaccaggtacttatcccataattacatctttgtgcactcactattgtaatccctggcattagctatgtaattaaatgatgaacagtgactgtgtaagtagagagtacttatgtaaaatttgtgtcttatcaaaaataaataaataaacagattcaaagactcaggtctcatttgaaattccattgttctcagggagattgtatagcatgtcaagaattgataataatactgttagctccttgaaggtgggaagatgatagtactgccactctgtcaggaagatgcccactgtggttcatcttaccaccagggatgagcggcgccaagcaagtctcacggtttttttcttggcatgcctcaaataacaagtacttagacactgtcttactaaatctgacctgtctctaagctatgaaatccagtagttttttgtcagatgctttgtgcaagaattcttttaaaaaaataatgttttcatctgatcacaatgctaacatatattcatcgtggaaagtttgtaaaatattgaaaacccacagaagaaaatagaaatcacttataattccttatcaatgttaacttttttccgtatatgctttcagtctctcttgtagatgaatctcactgtatctacatatatatgtatacttcttgcgacctgcattttagaagcggtatattgtgaacattccaatgaagtattattgtcttttatcatatttctcatgactccattataatctgtaatattggtagtccctaaattatttaaccagttttgatggacgtttaggctagtttttcaacattaatttctatcattttactattcaccatgtgagggttctctaaaagaagttttaaatgttgtgttttcatgaaaacatgttaaaggtcattcattctaagttattaccttgtgacaatgtcagtgcctgcgtttgcatctgtattcacagtgtgctgtgctgcgtgtcactttcattgttgtgagctgatgagaaaggacagaggtctgcttaataagtaaatgatcatatagttggttccaccgagtgaaaccaaaggacctcatagtatgcaggacaaatggaagttcaaatagcaaaaagcagtggcaggattgagccatcacatggaggtagcagagatacatcaaactcaaaactaaaaaagaaaatagaaacccaagaagttgataccatattcacagcagacagcaatcaaggctctcataaaaatcattagtttcgagaccagcctgactaacatggagaaaccccgtctctactaaaaatacaaaattagccgggtgtggtggcgcatgcctgtaatcccagctactcgggaggcagaggcaggagaatcgcttgaacccgtgaggcggaggttgcagtgagccaagatcgcaccattgcactccagcctgggcaacaagagcgaaactgtctcaaaaacaaaaacaaaaacaagaacaaaaacattagtaactctaaattaatgttgttgttttgaatgtcatgtgatttgtaagtattgtatttaatttgtagatttgttttacatttgtttggattgtatagttgtataagaaccataatcctaaagagccactatgtaatttcatattttcatacatctaagtaacagtaaaattaatttaagtcaacagtgagagtctgtaagaagtttccatttttaaaacagatccatacattttctcaatttgggttacattgtcctcatagctacatcattatgcatatccttagaataaattatttcctcagggaaatttcttaaacataaaattattgtcaaatgttataaacattctaaggcttttgatgtttctgtcaaatttgagtacagactgttcaagttacttttctccctttagtttacccttcatttttaatactttctgcagtagtacattcgttctagtttgccaaatatttattgagtgctaaccatgtgcaggcatcatgtattggcattgactagtgaacatgttaaaaatgcatcatcatggaccccacaccagaccaactgaatcagaatctgcattttcaaaagatccctaggtgatacgattgcatattcaagtttgagatgcattgttctaagaactagacctggaggtcgactgtctctctgacacttcctcttgaccatctcgaaggtgccccaaacacaatatgtttgtcttagttttgggagctgctattacaaaatattacaaaatatcataaactgggtagcttataagcaacaaacatttattaccctcagttctgaagttaggaagtgcaagatcaaggcaccagcagatttgctgtctagtgaggggcagcttccttcctaggtggatgtcttctcactgtaacaacacacagtagaaggtgcaggacagctttctgggctctcttttataagggcactggtccattcatgagggctctgcccttgtgacctaatcatctcctaaaggcctcatctcctaataccatcacactggtgattaggtttcactacgtgaatttagggggcggggagaggcacaaacattcaggctgtaacaatgctcaacatagagctctttttttttttttcaccatgcctagttctttttccagttttcctcttctcagtgagtggcatcaccatccactctctcatgcaaaccagaaaccttcctctactttaccccccatatctaatttatcaccgagttcactatctctcacatccctcctattttttcactctctctccactgccaccctccttgtctaagctactcttgtgtgttgcctggatattttgcagtatcttctgaactggcccccctgcttccattcttatcccctctagtttattttccacagtaagttgtggaaaagagtaatcttttggataggcatattggaacttatcaccagcttgcttaaaacgtccaaaggaccttccattgctctcatgataaagacagaaatctgtaaggtggtcccacgagattgagtcttgcttgctctctagacttgttctgtgccgagttctctaaggtagcagtcctctctcactttgctttctccttacccttcagtttagctagtgaacttctattgttccttagattgtagctcaatcatttcttcctcagaaaaccttccctgacctccctaattagattctttcctcttgttctgtgatctcaaattacacaacttattcccctgcgtttttatcactgttgtaactcaacattcatttttgatgtctttgattaatatctggcaccccattagagtgcaagctccattagggcagagaccacatctgttttttcagggccagaagatgataggtgatgtcttacaggtccttaccgctctggctctcttcatgagtggttcttccagatggaatgcccttctcctccactgtcacttaaataaataatacctgtctttcaagattgaattaaaggaacaacccctcaatatgatcttcctggcggaagtcctcttcaaatcctcttataaggtacttattaccttctacaataattactatgcatttttctctctctgtattaatcaacgtaagtaaccattagttgctgcaaaagataaacagaagttgaatttcacccatacccagttcagcttgggctaactgaagcacttcttcatccagtgacttgacgatttaggcccccttcatcttatcaggccattttcctagcatgtggctcacaaggcagccacaaagcatggagaggcctcccagtctcttaaatgacaaggcacagaaatggcatgtcacttgtgctgacatttcgttggctggaactagtaatctgactcctcctaaatgaatggtgcagtggaatatagtcccctacatacccaggaggatgcatagagctagatatgagtgaaaactagtcatctctaccaagctgtagtaaactcttgaaagaggacaagatctaagcccaaatcactttcagaacactaaagtattcaacctctcccatatttgccaattaatacaagttgctgattcaatgaatggctgaggatttcagaagagggagacaaaagcagagagaagcagaaaggcagatacagagcagcactagaagacagcatctctctcttagtccattactatttgtttcagctacttacacacttttgggcagtgctaactaaattgataaacagcctgccccacccccacccccacctcccaaagtcagttttttggggtttttgtttgtttttgagacagagtcttgctctgtcacccaggctggagggcagtggtgctcactgcaacctcagcctcctaggttcaagcaattctcatgcctcagccacctgagtagctaggataacaggcatgcgccaccacgcaccacccgcagtcagtttttgttataatagcttggcttcctatatgtgatattattgaaaagtttcagaataacgcccatgtgctggacagtgtgcaaggtgttttacatagactgctatacagtcattctttcagcaattctgcagtacaggcattcttatcacagaactcacaattttctgccttagaatgtgcattgaactctgtctgcctctaaaacctgtgttcttaaccacgacaccacattgaagtttattaaacatccgaatatttatcaaccctgagaatgagcgcatataagtaatgtgattaatctacccattataatccctgtgacttagccttgggaaatagactctaaggaaacacttgtagaattttgccaagacagtagccaaattccaaggaatatatgtgtatttaattaagttacatattctaaagccagggtgatgagcaatttggataatgtttctggtgtgtgtgcattgggggagtggtggtttccagatgagacaacagccacaaagtaccttgtcatttcttccattgatatatatactcatatatgtttgcacagataagactagcttttggctttatgcttagttttatgtacagtacaaacattaaatcgtgaaggtgttcatcacaggaaaaccagagaagccctcgtaagccttataaatcattgtccttatacccagctcactgtgggtggtggaccgttagagcacatggggacagagtggcagtctgtgtgatgttaagaatgcaacctattaagcagagaatgagaagttgaaggattccatttttcaccagctctaacatggttaatctttaaagctatttattgaacacaaagacatttgactgagcactttgtagtatgcatctttctctaccactctcattcatcacctattttcaccgaatctttgttaagatttgcagtaatggtgctgtataaaagggcctttatgtgactcacagtccctataaaatatgattttttttcttcagatcatcttttgaaaattgctgctgcttgttatttcacatatttttttccaagtgcattaagtttacctgcaacgggaaaagattatttagagaaacgtacactttctatttcctttaatagcttgtgttatgatatgtttgatagttcatgaaggacactgtcagatttggagaatgagccaataaactttaggtcctaagaaatatagccccgtaatgatgcctactcatatgcagagatattttatcagcttaatggtaccttttagtgtctgacaccttcggtttacaggtttgctcgatggcctgtttgcttctgtgccaaattagtgttgagggaggtttctgatgagaagaatattcagtttggatattagagttatggccgtcaagttggaggcggtcagcctggtttaatctcagatggtaccttttactgcagatgccgactggggactcatgaaatgcccaagcaactcttgtttggctgtaagggtgcaaatcaaggtgtgtgggcaggggagagcatctcttgcctacagcattaacagacattttattttgtaaaatatgttctatcttccccaggttaaaaaaaaaatcatatgctcatcttattttaaacagattcttttagtggtaaatgaaagcttgtaacctgtaaggtagcatttatctttatattcaaagcttgggcagccatggaagaacattgggagtgaggacacttataaaaggaggagaatgtggggtcaggaagcagagaatgcaaagaatagtgttctggaagaaaaagggaggccaactgttatctctaaactgcctatgcctgtgaacttcatccaagaacagaacatccaaaaaccaggcttactagccttgtctttctttttggaaatacagagtttcgcaaataaataaggggatacttaattatctccaagcaaacatttcatgtgaacagtatagcaaattatattgtgcatatataatgccaatgtttggagcagatgaagatgactgagttgcaaggtggaatgatgatcgtgaatcttctgtcagttactcctctgtcctggatctagtcattatacatttatttttcaacgtcttctgttttaaaatgactcttctccaaatactagatcacttagttcctttttgtagataatttgtatccttgaaatggacaggtacttcaaatatcacaagaaagggtagctttagttttcttttgttttaccggttagattatctggctgaggttgatttaactcagtcaggtaagctagtaaaagtttgtctttccttaataagactgattttttttgttgcatttatccaacaatcttgtatattctaaattttgtgcagtttaaataggacattgttaattcagttcatcaattcattacaaatgtgcagtacggatgctcacacatttacttcctgaatggtagatgcagggtaagaaaagcaaaaccagcttcatgatatctgtgatcaagatacatattaaggtgaatacggacaagattctactgagtctgctgaaaccgtttcaaatattttggggttttgttgttgttgttatattactctgtttactctaaaatcaggcacttgaggctttttttctcgcctcagaaagatatttctgaaattcatgacattgtaatggtgatttttattaaagcaaaatttgatggcttttgtttatgagacctgccaaacagtgcaaacacaatcagttaactatttcctttggaaggagtatggtaaatttttgtgtaagagactgtttacccaataaggggggatttatagtttccaaaagtgtaatataaaaacaatcttcagtttccccatgttatatatacatctagtaatatactttctgtcctgtgtagctaccagcaattttaatatatatagttactcttaaaaacttttatatgatacaccacttttttgttaccttctaataagaatagtggattctaggctagcaatatttcatgctgatgatacatatcttgtaagactatgaactttttgaaagcaggcatagcaagcatataatttaaactctactgtatgcattagagattacagagggcctgagtttcctcaagccacccatcttattaagtcatagcactgcatactacataatggatttgaattccgattgaaatcattcatgatcagggaatatttactctagatatagaaaattcaggcagctgggaaaaaagaagggatcgagttgtttcacaagcctgcttatgcgcctgtgtttgtgattgtaactctaattatatttgtactgtattataatgaagtaatttaattaaatgttccataagttgataaaatatttgctcaaaagttgtttatattaaaattatattaatactttagagagactcaagacaagttgcttttaaaaattgctattgaattctttataaacatatatgtcatggaaacctagggaggagagaatttccataaacagactatgcttcattgtgtgccaatgcctcaataataggaggaaaataaagaatgtgtagaggccatgggcttggcatctcaggaaccactgctgacaatgcaggttcgagtttcatcatatagataacggcaaaagctggatttcaatatcttaggcatgaggttgagggaaatgggggcagaacatggagatcatgattgtgtggcatcattcagcagccaggtgaagtggagaggcgggagttatggagaagttgatagtctatcgctgggaaggactttaaaagagtatgtatgagagaaaaagactttaaaagagtaaggtgtttaatgagtatgatgcagaggaaagagcaaggtttcggatttgcaatctgtgtgccttttattaatgtatttaacctctgagcatctagctgctccttctataaaactgaaataatatatgactcaacagattttgggcgaataaagttatatgtagatgatatagcataattcgttctttttctttatatcttgccttcttctgttggaagactgtattctactgagcatgttgatgggttagcataagcactttgggtgcaggcctggggaaagctgaatagccctggattcagaaaacagagttccagccactcctgcagatgattcaggaggctgcggctgggcagcagaggtggcagtgggcagtgaagggctagcaaatgagacagatgcctggcatgaaacgcgactacttccataggacccccacgcaaacaataatttctgtcatatctgttgaactcacagatgtttggtgtggatatagtgtgaaccaaataaggacctttgtttcatgccagggtcagtagggcaaaggaaagtttctcagggaagacaaaattcaaaagaccatcacaacttgatattcaagaatggaccaaaaaaaaaaaatcttaggaaagactttgtacttctacaggatgaggaaagagacaaggggaatagatggaaatttcagtaagacttcagttggcaaggaagccctgagctgactcctgggccacatataaagccaggtgtcttcaacataactgacatggaatcagtgatgctaattagcataatattagatcaaagatgcaccaaagggcattgttgaaggtccactgtccacaaagtggttggaggaatgggactgagatgatggctgagtttcttttctttataggacatgcaattaatgactgcagccgaatttcggctcttgtgttccgtcttcctaattcctgagcattggtcatgaacttgctagccttgccacaatttatccagtaaacaatgttttactctcacctttacagaaatctaagagctttgaaattggctacatatagatgtaatgtatgtagggcagggagcacccaagagaatttttttttctctaagattacaagatatttaccagacctctgaaaaaaattgctggagttataaatgtgctgggaaccacctaaaaatcccaaggaatattagtttttgaaattggtgccaagatattgaccattgttgcattcttataaagatctagaatatgttcttatgaaagaaatttttatcataattgtttaagtcagcagcaaaatcgcggggtgtctgttatgctacccacaataatactcctggacagagagaatgacaatatcagttctttaaaaatccaacacaaatatctccttccttctgtttgtacaaaggcaaccataatggcttttgcttccggcagactgaagtaacatgtggggtctctgtagaaacacttggagtctacaaaatgagcttttagcttatcccctggtagttaattactatacctctaggtcaattagatggctctcaattgctcagttgtaactgtggtttcactcacaagctgtgtgtggtaattctagtttacttgttttcttaagtaaaactcaaattgccgtgtgcatgagatccagaataatgatcaaaactgaagtatgctgaagtgggctatgtaattaaaacaatttcatcaaaagcttcgtattttaagttgccattatattggtaatgctctcttggttcctccaaagaccatttctaaaagtaaaaaataaaataaaaagagcattttaccttcataactagcactaataatcagatatttgcatgatctgaaatgaaacaagaggtacacagtccaaggtggtcgtgtgtattgaaggaacaacactgcactggtccaccggggatacagctgaataacctggaggtatttgttgtcattcagtattcccgggtgcagtgccttttcagctgccgcaaggttaggcatacaggagcgtgttgcacacggctgtgctcatcctgccgttctaatgtgaatgcattatttccagctttgtggaagctccagcacatttataatcactttctactcactcttgactatgactccttcatctgacaaaccctcagtgaaacatcttctgcctgtcactgtccccctccactcaggaaagccacagaccttgtttgtgcattcagcaaacacttactgaacatccactgaataccggacactgctgaattccagggatataaaagcgagtaagactcggacccggtggtcaaagatgctaatgtcttgtgaagaagacagacatttagacaagtaattacaataaagtgtaagaactcttactcaaagagggaacacctaattgtatccaagagtgatgtgcagaagaggaatcagggaggccttcccaacggagctgatgcttgaactgggtctagaaagatgcaaggaatttgccaagtggttcaaatgagaagtcaagatattagcagacaggggaaagaacatatatgaatgtggaaaggatggctttgtgtttactaattcgatctaccaggtggatgaggttgccataatccaagaaaaggaatataaaaggagagaaggggatgtgtacaaggagcccagttagcgtcttctgtgttattgtcactgtcattatcatcatcatcatcatcaaaccatgtttgtaaaattcttctaacacgttcagcagactgatttttttaaaaacccataaaaacatattgcccattctataaagattcagtagtatgctgtcttcctaatatgtattctgagattatggttctgcctgtactattaaattataaagtaagtaatgactcacaagttggaaagctgaaattgaccaataaccacaaaatgatttaaagatatcacttttttatatttcaaagaaatcagtaattcctgtgctaattaaactgtttcacagcataaagaaaaaactgaattttttccgaagcaagtgtaaatagttatccttttattatagaatgcaaaacctgacaaagatagcgcagtaaaaggatgccttgaaaaactgatgatgtaatttattcaagacaataaaggtataaaaagatctggtaaaagtctggaaaaaataacaatgaaaagtctaatggagtgtgaataattatcccagatattaaaacataaaactatagagattaaaacaatgtgggctttggcctcactacacaaattagttaaaaagaaaaagaatacagaaatagattcaaatatatgtggtaatttagtgccataataaagaatataaaataaatgaaggaaggatgacttttcaatagtagtatagggagagttggctggaagctgttcaaaaaatatgaattcaaccattcctctttatattaatttttaagttccagatagataaaatagtgtactataaaaaggcatacataaatacataagatcgaaatatgagtaaacatttttacaaacttgtaatagggaggacccacaaagaaaaagactaatcgctggtgactgcaacactgacacataaattctataaccaaacctcagtgaaagactaaatcaaactagcaaattatttatatcacttagaataagtatccctaacataaagagtcctgattaactaattttcttaatgtgctaataggaaactaggcaaaggaagtgaatgggcaattatacatacatacatacatacatacatcccaaagaaagaaataggaatggcctatatgaacatgaaaatatattcaatcttgctaataattaaggaaatgcaagttatgactatactgaattatcatttatgatttattagataaagatgaaacaaatcataatatcatctgttggcagtatctgaagaaatgggcatgctcatgcgttgttggagggagtggggcaatttttaatcaaaattggaaggtactttatctagcaacccctcttaggaattaaagatatttgaagaagtattcaagggtattgatttcagctttttcgatcctaatgaaaattgaaatattttaaatgttaatcggaaggagatacagttgatctatgcagacatacaaagcttaaatgcttagagggatcatggagctagttaaatgaaggagtggttcaggtggaagacaatagggagtgatgggatcatagagaatgggagagtgtcctcacaaagggacaggcactctcggctccagctatttgtcaccatcagggaatgctgagcccaggctgccagatttttgtggaagagaagttgaaaatcgaaatttgagaatgcagtccccggatttttaaactaaaatgtaaaagaaaacacagtgcggatcataaccaacactttcgccaactctggatgtcataaatttgtttcttctttgtttatctaataggtcataagtgatcattcatgttagtcgtaacttgcatttctttaaaattattagcaacattaaatatattctcgtataggtcatccttattttttttttttgagacagggtctcactctgttaccaggctggagtgcaatggtgtggtctcagctcactgcaacctcccgtcttcccgggttcaagcaattctcctgcctcagcctcccgagtagctgggactataggcatgcaccaccacgcccagctaatttttgtatttttagcagagacggggttcaccatgttggccaggatggtctcaatctcttgacctcatgatctgcccaccttggcttcccaaagtgatgggattacaggcatgagccactatgcccggtccccttttatttctttgataggtaggtatgtatgtatgcatgtgaattgtctattcacttccttttcctagtttcctattgacaaatttactttaaaattaattaatcaaataccaaatttagctttcaaaatccagtttgcaccatgtgatttgtgcagtgaaagacttccaggccatcattgtggcaggctgttctgctgcccccacgtgggctgtcccatctccaagacaggattgtctaccccatgctctactgtgtgcctggcagtgctactgtgtgcctggcagtgctgctgtatgagcagtgcactggcccagcccgttaatgtggggccaagcatgtgtctccttttggccaaacacatacgagtggaggtgacacacaccttgtctaggagaccttaaggccataacaggtctccactccactgttccacactctgcatctgtcctaaacagggaccacctgaatcctggaatgagatggcacatgaagcagaaccgtaatgaatgacgaacccctgatatgttgtgtagttataagtcaccaaaactgttgggttcatttttgtagcaaagctgactaatttttaaaattgtttaaaatatggcagttttcactgacatgaaaagatctctacactatatggctgagtggaggaaaacagcagcaaaacagaatacataatatgaaactttttttgtttctttacttttttcttctccttttttttcttttttttttattatactttaagttctagggtacatgtgcacaatgtgcaggtttgttacacatgtatacatgtgccatgttggtgtgctgcacccattaactcgtcatttacattaggtatatctcctaatgctatccttcccccatcccccaccccacgacaggccctggtgtgtgatgttcccattcctgtgtccaggtgttctcattgttcaattcccatctatggtgttctcattgttcaattcccatctatgagtgagaacatgcggtgtttggttttttgtccttgcgatagtttgctgagaatgatggtttccagcttcatccatgtccctatttttttgttgttgttgttgtttttgagacggagtttcgctcttattgcccagactggaaggcaatggcatgatctcggctcaccgcaacctccacctcccaggttcaagcgattctcctgcctcagcctaccgagcagctgggattacaggcatgtgccaccacgccctgctaattttgtatttttagtagagatggggttcctccatgttggccaggctggtctcaaactcccaacctcaggtgatctgcccacctcagcctcccaaagtgccgggattacaggcctgaaccactgtgccaggcccattatatgaaatttttaagtaaaatgttgcatattaatatacctccatatagctatatgtatttttaaaaaagcctgttagatatgcagaattggtaatagtgattgtcttgagacgctggacttgggacagcttttactgtagtttttccactttcctgtattcttgatttcctgtaacaaatcatctttgtaaaaagaaattaatatttctacatgactgatggttaaaagaatctcaagagccatatagaacataaaatgattccaccagaataatttttcaccctcaaaaaagtaaatatcttcatctcataaaaacttgattatagagccaagactagccaaggcactcctgaaaatgaagatcaaagagaaaagatttgcttatcaggatttcaggaattattataaagctatactaattaagacaatatgctactggcataatacaagtatgtgaaccaattttaaaaagtggagagtctacacatatccagaaacttgattcatgacatagttggcattgtagacaagttggaaagaaacagagtttccaataaattgtgctggaaaactggttgtccatatttttttataaaaagataaattgggcccatacctcctattataactcaaaaattaatgcctcttggcttaaaattttaatatgaaaggtaatatcataaaacatttagaagacagtctacaaaagatcttaatgactttaaaggaagagaaagatttctttaatataaatctcaaacgatgaaaaaattaattcagctacattgaagttgagaacttctgttcatcaaaagatttcatttaaaaaaattagaagataagctacaaaacaggagataatatttttaaaacctgcaaaaggcaaaaaataatatgtagttatttttcagtgcttatgatgtgccagatgcttatactaaggctttacatgtattaatgcagctaatttcacaacaaccccatgagacaagtagtattgtcatccccattttgtagatagcactgaggcacaaagaagttagggaacttgctcatgcccacgtagttaggaagtagcagagctggaatttgaacccaggctgacttgctttgaagtctgttattttaatcactccaacatgacgttatactgcctcagctatattaaaggatgataattcaaaatatatgaagagcacctataatcaataataaaaaagactagcagtacagtgcaaaaagggcaaaagattaaagggtcattttacggaagaagaaaaataaatgatcagtaaatatgtgaatagtagtcaatttcactagtaatcagtgaaatgcaaattatagctactttacatccacctgattctacaatgtagaagagtccacatccttgccagcatgaaataatggtatagaggagttcatatccttgccagtgtgaaatagtggcacagatatggactcttctacactgctggagggagcatagattgacaaatatattaatgtcatcattctcttaagagttaattaattgatattttggtcctactatgtaaaaattttatggaaaaagtcatctctttaggtcacatttttctcccacatggacacatgagacagttctattaaaaatagaagcaaatatgtctcaattgataaaatatgtatatggagtttattaagtggtttgtaaaatataaaattcatctttaaaacttgaagggaagtatgagcctcactcaagtctattttgattaaaaagatagtacatatttgagtgaaaaaaattctttaacttattcttaagggcctatttaagacagatttttatcccaacttggaggcgttgacaaaccaaaatggtaactgttaattgatggcaggtttttaggcagtgggttttttgttttttgtttttgtttttgttgcacttaatatggtgccctttgtctcatttctcactgtcccttttatgcttttgtcttaaaatattaaatcagcaaggaaagtgtcagaagattacagtttagttcattgcaaaccacagcttatctttacactgacctgcagaacagtcttagtgatgttattagaaaaacaccagagaggaacagaactgagaagaaaaaaaaaaaaaaaaaaaaagctttgcttttctagaacagtttctaacagtgctaaaaaacatcatgttttgaactatcattttttgactcggtaatcatgatagcgagcaaatgccctctatcccctcagttcagtcctacagaattaagtcctggaaacagcggctgtccagtttgttaaagattgacctaggaaagatctcaatgctaccagcaccttatagggcgcaaaatgtaataatagggtaaattatgttttctttttcacatttgcacgctgagattgttttggagatcttttaacttagctcgttataatcaagttgtacagcctttgttttaataagattctaatcctgaggtctatccttcgcatcaatgactttacactgttaattgctttcttgtcctccattaaattgcggttgcagttgcttcatcttaaaaggcgccttgtgctttgtattctgccccatgctctgcagacacacttagtaacatcatcttcctaaagaacaaaattacctattatccctttaatcttgatgtacttttttatgtgtttggttcctagctagtgtccaaccaggaagctacatattatcttcttttaaaaaaaaatgtttttttaaaagccgcatagtgtggatggccaaaatttatttctcaatagaactcacatagtgcattcatttattttttataggactaattaaaaagacaaagggatctattctccccttgatacaccagagtgacttccattaacattaatggaagggaaatacttgcatggagatgagtggagacctcatattagaaagtgaaaacagcagagtctggagtgaatgtccccacgtttttgatgagagaagctacacaaaaagcaaatagctcaattcacaaatgtgttttccccctatgctttctgtttgtttgtatattgaggaaaatcagcgaatatttggaggcagttccttccttcagaaatcaattggatgtgaatttgtaattttaacacgaatgacacaacttacaggaggaactcagcaatgagaagcaacggggggatctgacaggtctttgctgcagtggagtcctgtgagacctgcttctggaggcagaggtgagagtagaaattggatacctgaagaactctgtacacagaaacttaattttcaaggaagcccagctgtccgtgtcaagctgatcttttgacacatctttccagaaatctatcaaaatctggagactgcttctgacttttcagtgtagcctctgaatctgtgatcctcttggcccccttgtataccttatgaaagttttaaattttaaatgtacataatctgacacacactggggaagtttctcttttatcatgtcattcttaggttaattaccagggaattaattatttaaagtgtgactagctctccatgctgtatattgttttaaaatattgatacattcattttgcatctggtgggtgctaagttcaaactgctttttaccctttgaaaatgtacttcaaaaatacaagcagtcttctgagtaacaaacctctccgtggtatcttgccactgccctccatttccctggcctggactttgctttagctgcttaaatcaggctcaggagcattatattttgcctccagtctctccctccccctgtctggttagcactatctctggaattttgttactattcatactgacctggaaaatgcttctaagatactttcttactttaattgcttcctttcttaactatgacaaactccctgcttcagaaccttacctggaactttctttggagctaaaagagattcaaatcctttagccagagttctttgttcagcttaaagtgtgactttccctgtcttatatttatcacctttaataccttctcctgtcttgggatccaattcagccttcatctgctctcgtcagaatttcctaaagaatcatctatatttttcttctcacagtaaaaccacattttcctccatacttcctatgttgtgaagtggtttgcaaaatgtatccagaggaacttgggctggaggagaaggagaaggcagtggcaaggagatcccataagcatttcattttaactttgcattttaaaaatcctttcattcccctaagattttttagtgcgttagttcaggacctctgagaagctgacaccaagacgaggtgaaatgtgcaagagctttactgggggacatgcctatgaagggtacagggaggaagcatgagtaagtaaggacggcctcagaccaagaggtaagtctggcacctgtgggaggcagtgtggggaaggctaaaggaaggaacaatgattgggtagcatggtgcagttctaagaaagttttgaaaagaccaatggaaagtcctcaagccaatcacctgccagcaaagtttcacatcaggcaggaatggaccctgtaccactactcccaccaggctcagcattggttggctgggaccatcctggaagaatttggcagcaccgcacatggtgctggatccagaggggtggcatttggggttttgagtcaactgtgctcccctccacaggaaatctgactagcacctttttaggccaccactctcagctgtttgttttcctcctgcagtgtggctgttgccctcagaagagatcagcaacctgtcaagacagtcttactcctactggccattctcccagggccaactaatgctgctttggcagtcaccatgggatcactatagacagtgtggatttccccctcacaagctctgagattaatgacacctgtacatccatgaaattagctccaagactatactgtagccaaggctcaaaatctatttcctattccccatttcaaattatatatagtcatgtttctaaaagacagcataacaggttgtagagatcaaacaacctgattaagatatttaatcgactgtcaacataaagatgccctaagtttgaatacaaactccctaccattttcaaattcctggagagaaatttaagtccaaatattcaatcactttacaaattaaagtccaaagaacataaagtctgcaatcagattctcttatcctagtgagctaaattttaaaaatatatatccacagtttattctctccaatttttgatattgctcagtgccaggtactggggttattgatacataagacgagttaggattgcttgaacagcttcagcctggagtttctatcactcggatggatgtagtcccttcagtgcttcataaattacagctgaagtctgaaagagttcaaaataaatccttaaaaatctcaagattattattggcctggcacttacccaaacgagaaagtgagctagtccccagctactaaagtaattagtctagtgcccagggttactaaaactgtagcagagattgagtgctaagtgagtaaaggagagtagttggagaaaatattggttttagtctttttttcctttgaagacagggtcctactctgtcacccaggatagagtacagtggtgcaatcatggctcactgcaacctcaacctgccaggctcaagcgatcctcgtacctcagcctcccgagtagctgggaccatatgcctataccaccacacccagctaattttttttttttttttaagttttgtagaggcagggtcttcctatgttgcccaggttggtcttgaactcctgggctcaagtgatccacccacctcggcctcccaaagtactgggactacaggcgtgagccactgtgcctggctggttttagtcttccaacaattccagtcaggctatatctgatgcccagaatctatgacctgtgaatataaattcaacggaaagaaatctttccataagaggttaactagaccctatacatttgtatttatgggaaaaagtcatccgtgtaaatggtcaactccagtaaatgttcttgaaaatggtctactccagtaaatgttcttaacctggttattcccctttcaaagcactcatctggaggccaagaatcacatctgtcatgagcaccatggaatccctggcatccagccccatgcctaacataaaggagggacttgataaataattgtttttatgaaaagaacttaagagaagttaattcctcctcatgtcattcaagcttctatatcagcttagttgaagaatagcctggtttatagggtgaactgttaaaactcttttaaaatttacaactgtgcaatgcagggttttcttaatactatgtaacaataacaaaaaaataaatcaagctctgagactagcataactgtgactaacttccataagctttgatttccaaattctatgttaatcactatacccacattattctcattgattgactttacaacaagtaaatatttactgttatgactgtgttttaaaaattataattataacttatatttaccctaataaaataatacatttaacatgcatgattttgttttaaagctaggtttctgctaataaagtttgaaaactactggcttggcgaaagtaaaattggctttgagggtgagaatttgatctggattcagatttctctctgccttaacatattttagactcaggtaactattttgtaaaatgggaatgattatatatacctcaaaatttgtttcaggattgagaaagttcagtaagaaaatcttaaaaggccctggcacagagcaggctctgtgtcttgttttcctcctctcttaacaaatgcctttattcaaaacaatcacagtagattatacaggcctacagacaaaataggcatttagtaaatctgctgattaatttcatttttcaatatttgaagatattttcattaaacaattttaactgtaagtgggttaaacagttttcattattagaattgactactttcttcaaagttttcgtattactttattcatacctgggttccagtacatgcctccccctagaatttcagcacctagagtacaggattatatcctagacttcatctttacagtgaaggccatataattgaacttcgtaaattttgaacaaatactttttttaaaaaaaaatcagaaacctatatataaaactacttatgtaccagcgctttgtaaatattaattcacttaatctttataatcccctgaggttggtacaggttatccgaaatgcttcaatgagcatttcctttaaatatgatgtttgagtgtcaactcagtgctgaaagagttttagattttgaagcattttggattttgaattttcagattagggatgctcaacctgtactgttattatccccatttcctagatgaggaatttgaggtctagaaagtccaagtgacctggccacagttacacgtcttctaagtggtagagtccagcttggagctcatcattgctttgctttaatgtccattctcttgatccttgtaccattctgcctcccattaatgacaatgcttatcatcatcaaaaaggaagctgcggtagcaagctgatgagattggtaataatttagctccagaatttttgtattacagtttctatggtaaccttaactcttccctttcggtatgtgctcattcatacagttgagctcagttagttgcaggtgctattttgctatttcgtctcacaggactactttatccatcaagcactatgagcaaaaggccatgggccttatgaacatgtttgagaatgaaaacaaagtttttactccaaaataagaaagctgcaaaattaaaattaagaaatcccttaatttaatagctacaacatgtaatataatgcccacattattgttaaatgtagttttcatacacatttcaatacacttgcagtctgtaggtttaattgctcacttcattagaattcccaagtaagcaggatcattgcagaataatcataaccagtcatacattatataagatacttatagcaaatattttaaaataaaattataaaaaaattttaaaatattttataataaaatgttatatttaatgtgagtaccttttactctgacatgacatgtagaggatctgatgaaggtcttaaaggccttgttaggacttacttcattttaatccttgacaaactaaccagcaagctgcctacctacttctctgtacacactagctatactgaataaggcaaagaagaaagcatacaccgtcttattgatgagttttataagtaatccactttttaaaagtaatagctatttttcctatccattaccatgcaaattcctgaattatttctaattctcatttttctgatttggtcattttgagatctacttcctacaagaaacagcagagaacagaaaatgtagattccgtgaacacataagacctctcagaacccttcggctgcttgcttgattttgaatattccatgactccttctctgcatggagtacaattctgagcttttaggaggccctagcaaattaccacgacctaggcagctttaaacataacacaaatgtattaccttacagttctggaggtcggaagtctaaaatggatctgcaaagcttcatttttttttctgggggctctgggaaagaatctgtttccttgcctttttccagcttttcgaggctgcctgcattccttagttcatgcccaccttcctgcatcttcaaaactagcaggatctggttggtggatttctcaccctgcacccctctgacctcctcttctgcctccctcttcccctttgaagaatgcttatgatgacattggtcccacccaggttgtccaggataatctctccatctgaaggtccttcgtttaatcacttctgtaaagtccctgttgccatgtagaattccaaggcttagtacatgtgcatccttgaggggccattattttgcctgccacagaggcacaaggcaaaatctagaagaacagatttctcagggcacctaagctgctgcccagcacacactgttagttattctcagaggtatattcggttcatctcactctgctcctgctactggttccctaatgcaccttacattctgcttctaaagttgctgctgcctctcttcctactcattacttttttcttaaacctaataacatggaatatatgattcactacctccctttgattctgttggtaataatgccctgtgcagtagacccttggtgggcagagcagtgtatgtaggcacatgtgcacgtcatgcctgcacacccccatcatttttatttcccatctttacctctgggttttcactactgtttattcagaaaatatacatatattctttagagaattgccacatgcaaggaattcattcaagactttgtgtgaaataataatgtacacagctgtagtgaacttgttttctctctccccctaggcgcaatccccctccccttcctcttcatgcccagtcagttaaaggtaccagaagcaacagtggcgtagacttgtcagactcagacctgccacttagcagctgtgatatcctcctccgcatattccttaatctctgtatgcgtcagtttctttatagattaaatgcaaatagtggcagcttttccacttcagactgcgctcaggaatcagtatttcatttgatttttaaactgccatcaaggctaagacaaagcccttatgagataaaggccaaactcctcaggatagctctacagggctcttccaaatcagatcccatcctgaccttccagcttcaccttccattgcttctactgcatctcaccctccccaaaccagatctgcttgccaggcgccagacatactgaagacaggacatgacttcaggttagcttcatggttttttttcttttttccactttgataatgttaaaaaaaaaaaaaaaaaaaaaaaagacgaagtgaggtgggaggacaaatgccagccagtgttagagagagattttctagaactcccaaggagaattatcatgccttgagaaaggggaggacatatactgaatatgtttaaatttagattaaatgtatgtttccttttacaacatacagttaatcagagataactttgtagcgatcagtgattcctagccagaaggctaggaatttggcattattaaatcttatcttccctaaataaagtaaatgggatacccacaaataactgagtcctcattttactcaatgggcattagaagtaactaaataaattgaaagttggctgttactgaggatgttgcaacctgatttggggaggagtggaggaggagaagaccatgagaactctcacctctggacagggcttggcactccggaagagttccactttttatgcacctgatcccttagcaccactaggtggtaagaaagcaactgaaaccaacctgagaagggccattgacattacatcctccccaagtcacctccatatggaggaagaatgactagacccacaggagtgaaagccacaaggtcagaggaaaggggctgctgctaccacattctcagctgcactcttggtcttgataccctttacatagacctcttttacttcttaaatgctgtgtcaagggcactcaatttgactattctgagtggatgaatttttaataagtggtgtttgtcaacacctgtctccccatcggggagaagccttctgggacccaggccatgccctgtcaccctgtcacacctcctgaccactatacatgctgctccagtaactgagccaccccccaccctccttacatgctcatcaggcagtccgtgctcagcagcccatctgtgaagcatttcctagccggctgccacacccaacacaagcaaggaaaggccattcattaatattttatgctaacctttaatgcactatacaggatatatatgtgtgtagaacagaattttcctacagacttctcatgaaaacatttcactcactgggctgggctggtcaccatagaaatcaagttaaatgactacagtgcctgcctgttagaggcatttgaatgtacaccatagcagggacaggggcacacaaagaaatgagagtaaccctctgagaaaaatcctaacttctcatcccgcctgccaatatttttttcctataagatagtaaataactacagcaaaacttctactaaaatgcatgactgacatttcgttttttgctttctagtttgcaagttgttttcatgttcgttatctcagtggatcttggcaacaacccagtgtaaaactcgttgtatttttcattatttatttatttatttattttggaaacagagtctcactttgtcgcccaggctggagtgcaatagtgcgatcttagctccctgcaacctccgcctcccaggttctaacgattctcatggctcagcctttgctgggactacaggcaggcaccaccgtgctcagctaattttttgtatttatagtagatagagggctctgccatgttgcccaggctgttctcaaactcctgagctcaggcaatccaactgcctcagcctcccaaagtgctaggattacagacatgagccaccacgcccggcctaaaacctattttatttatttatttatttattttcaagatggagtttcactcttgttgcccaggctggagggcaatggtgcaatcttggctcactgcaacctccacctcctgtgttcaagcgattctcctgcctcagcctcccgagcagctgggattacaggtgcccaccaccatgcccagctaattttttgtatttttagtaaagataggatttcaccatgttggacaggctggtcccgaactcctcaggtggtccacccacctcagcttcccaaagtgctgggattaaagccgtgagccaccgtgcctggctaaaacccattttatagatcatgaaattgaggcccgatttcatcagttgaggcaattgacttatctaaagttacagagccggtgggcgtggcagtcaggagagaagagtgtggtcatccatctattcatcctccaccaagcccttagcaggcagctgccatgggaagagcacaaggaagagcacaagggagatgctgataaatgaactccactttctcccctcaagccgctgctgccttgcttttcccatgcaccatcccgtgtttctccccgttcctccttgtttcatctgcctattatttcagtaactcattctgtgctcaaaggaagcccccgtatggtgtgcttcctttatgtactatgtttctcaccactacaccatgcgctaacacaagactattcaatgattgaatctcaggcttgtgacttaaacagtttcccacacattgggacatcgggaagcatttggggggaagaactacaggagacagggcagcctagttctagaagtcatcatcaataatgaagatacaacaaggccaccaaagcaagggggaaatccagggaaattttacaaacaaatgataaaccattgattgttgattataggaaaagctcacagaaatcaattaaggaaattaacatatccatacaatgaagggacaaaatatacaaaggagcacttgataaacaaactaatgactaataaaaatgactgtagtctaactagtagtcaataaagtagatattaaaacaataatcttcacctgtcaaattagtgaaatacatatatatatatatatttgtgtgtgtgtgtgtgtgtgtgtgcatatgatgaaacaggcacattttaaaaatactgctggtggaagaacagtgtgataggtctttcagtaaaagtaactggagctatgtatcaagagcttcaaaagagttcatattcaggttcagtaatttcatttttaggaatctaccttaaggaaataattagaaatttggtcaaatactcaaaacagaaatgctcaacacaacatgatttataaaagtagaaaattgacagcttagatgaatggtaaaaaaaaaaaattccatgaattatcacaaagctctgtgctgtatcataataatgcaaagaatatttaaggatgtcacaaaatgtcaaccacaattaattctcctgaaatcttggaagaatgtcatcactcttcatatggtagaaatggtgggtgacaaggggcttcctccacacaaggcagggagggagcatggggctgaggaccagacctggctgccaccacttactaaccgtgtggccatggcaaagttgctagactgcccagagctcccaattccccacagtgtcccttacacctaccttagcagacaaattgtgagataatgtgtatgaaaacgttgatgtggtaaagaagctagggcagctgctgctggtagcatagaatgcaggcactggagagaaaaaactattagtgggatggataacaggctgcaaaagtactttatgaactaaattgcagtatgtgtctaaagtaatattttaactgattacaaattttcattctttttcacatacagaacattcatatccccagctgccctcagtatcttaaacattccaattgcctaattattcagatgtcctccaccaacacagtcctgagtcctttgatcatccccatccacaccagcccccaaaggtggctccaaaaatcacccagacccctgcagggtagccctatgtcaaaggactagctctagggccagaagacctgattcaaagcccagttttgtcacatgccagttgcaaaccccaagccaaagtgcttaactactgtaaagccacagtttcctcaactataaaatggggatagcagcttctacctcatagggatggtgagcttttatttggattatttcatttaatcatctgtgcaatacctggcagagaggaaacagtacatggtaggttttattactactactgcctctaactcatagatggctttcagcttccagttacacaatgctgttcctcccagcactgctcacatgttctagttaaggacaatagaagcagcctccagagtgtaggacaatgtcagcctgtgcagaaagcatagatggagtcacaatgcgtggcccacagcctttggggctatccagactgctcatggatgcccccaaactgtgactggggacatctcaacctaccctgatgtaggttttgggaataggtacaaattgaacatgtggttagcatttgtaacacttcatgaagatattgggaggggtgggtgatatgacctagccctgtgtccccacccaaatttcatcttgaattgtaacacaaattctaatccccacgttttgggggagggacctcatgggaggtgattagatcatggggtagttcccccatgctgttctcatgatagtaagtgagttctcaggagatctgatggttttataaggggttttccctgcttcacttggcacttctctctcctgccaccatgtgaagaagaacgtgtttgcttccccttccaccatgattgtaagtttcttgaagcctccccagccatgtagaactgtgagtcaattaaacctcttttctttgtaatttacccaatctcagatatttcttcatagtggtgtgaaaatgacctaatacaggtggtatatcagggaagacaaaagtcactggggaaggataggatagagaggaagaaatctggtgttgtctattacacctgtggaaatgataggattctgaggtcatgttgaccaaagagcagggatttgggggtatggaataggccaccaattgagtcaaggcagatggagactggtttatgccacatgcgtacccagcttgagtggtcctgccctgagcagtgagcaagtgaccagcaaggacttccaggtgcctggtgtatttctgctggtgaggcagtcccagacctttccttcctgtcacttcattgcctttcagcttatctggacacctacttggtacttccccatgctgaaggctacatcatagtcatcactgtttcttacggttgactggtggagacctttccattttatgtttcttttcccgattgttcaactgttaggaagtgagataagggaaatgagtatgggctttgcagtcagaagaggattcacacttctactgtgccccttcctagttctgtgtccttggcaaagttgtttaatttctctaagcctccatttctaaactatttgtaacaaaaatataaaaatatgacatcacactccactgttgtaaaaatttattgagaaagaaaagtatttggaaaaaaactagaatacaatatatggttagtaagtgatactgtttttctctttggacaaaaaacatttaagagaattactgaaatattattcttgtggcattacgaatatctagtcaaatatgtttgtaaatgtcttgatgatcaaaaatatttgacagttatggctgggtgcggtggctcacacctgtaatcccagcactttgggaggccgaggcaggcggatcacgaagtcaggagatgaagatcatcctggcgaacactgtgaaagcccgtctctactaaaaatacaaaaaaattagccaggcgtggtggcgggcgcctgtagtcccagctactcgggaggctgaggcaggagaatggcatgaacctggggggcggagcttgcagtgagcggagatcgcgccactgcactccagcctaggcaacagagcgagactccatctcaaaaaaaaaaaaaattttttttgacagttacaatgaagccaagtgctaaggatataatgattaaataagacaaagttcttgtcagttggaactttgattctagttgggaaagacatcagataattaacatacataggtatatataaatatatgtattggtatatatatagataagatgcataaactaatgtatgtatagaaaaataatatatccatatgtgcttagctgtgcacttttaaatgaacatcttgccttttgattgattatcttagctggtgataaggacatgtgaatgaaatcccagactccaaagtatcaggttctaaagagattagagtgaggaggtagattttgagctaagaaggatcatgcgttaatgtctaagaatatgcatgctataaattgtgacacctctgaaagtgaagtcagctggctttcctaggccagcaaattgctggtgaccctggagaattgtataaggccacaatttaattgcacaggctttaagagatctgcactcctttatcccattaattcaacctgcaactttgttctctggtcccttttgaatattcagttctcattgatttcaatgggagttacagactcagagaaagggaagaattgggccagtgatctgttcaaagcaaagcatcatttaaagtatagttttaaagtatttgcaggcacataggtgagtcagctccttctcacgaatttgtctagaatgctttccagtttaaatggaccatcttaaagggcagtcaccttccctaaaattgcagcatcatactcatgcaccacatattggattgtgactgctgggaggcaatgactccatgttgtggtctcaactttactgcggaattgcttcagatttaagctatagcctaatcgtaattagcagcccaaagtaacattataaattcctacaatgcctattgggctctgtctgctgttccacacatcaagtcaagtcaatatagccttgccctcagagaccttttgtttgaaatagtctcggtctattggtcatgcaccaacacagaggcaaagaagcaaaatggctgtaaatacaacgcttaaagcaagtgaacttgcacagacagggaacatggtgctatgatttcagctctccctcgcctcatggactatataggttatagcacttggctgcacgataaatttctgtaaagcacatcctatttttgtactcatttccattgtgtaatcccacgtgcattagaattcatgaaagtcttatttgaatatttctttaggagagagatcccgacagtgtagactgccagacatccaactccccaactactctgtgtctgtccagacttctcagtgctgatacaagctgcagccttgggagctcagggccttctgtttactgggagctctttctctgaccaagagaaagttatctgtatcccactttgagatacccagaatccgtgcttccaacacctccctgttccttctgtctgggtatttatattgcttaggaggaccaggctcaggactggccccctgtcaggaactgcctctaggcgtggcgcaaaaaattaagttcccagttttcacttttgcaatacaagtgaagagagctgctatatacagccttacaggtcgtacagtccaaatcagaaatgtggcgacactgccaatgctgaaccttgtcagcgctttgagatggcgtctaactctgactgccactttagtggctgtgctaccttgggcactctctggatcctgactttctccctctctaaaacggggccggctgggagcggtggctcgcgcctgtaatcccagcgctttgggaggctgaggtggatcacgaggtcaggagatcgagaccatcctggctaacacagtgaaaccccgtctctgtgttgtaaaaatacaaaaaattagccgggcatggcggcgggcacctgtagttccagctactcgggaggctgaggcaggagaatggcgtgaacccaggaggcagagcttgcagtgagctgagatcgcaccgctgcactccagcctgggcaacagagcaagactctgtctcaaaaaaaaaaaaaaaagaaaaaaaaaacggggccatgatattcaccttttagagtgatcatgtggactacattagacaaagcgagcaaaacgtctgctcactatgtagtggtttttggttttttgtttgtgttgttttcaacgagagaggttatttaaatggataacatccttaccatggagtaaaagctcatatgtgattaatattttgaaggaaaaattcttgtttacttttctcagatattgaagatattcatgctaaccacattttgttcataataatgctccaaggaaaattttctgcagggcttgattcttactacagtatttcaggccggctcagcactccctcacctggtattttccatgtaaacaagtaacaaaataaataggggcaacaaaagtcactgctattgtaattattaacaagtattctttggttgattggcttttcttatgtaaaattctgtttctaataattgttaaaatagtaaataagaggtcccagaaataagatttgtatcatgtttaaactccatttcaaaatgtttattgccttgctgcaaaataaaaaaaaatctcagatttgtgtgatgtgtcctagcttacagcaatctattttttagtgtctttttttttttttttttttttaagaccaagtcttgctctgtagcccaggctggagtgtattacacgatctcagctcaccgcaacctccgcctcccaggttcaagaggttctcttgcctcagccccccgagtaactgggattacaagcgtgcaccactgtagctggctaattgttttgtatttgtagtagagacggggtttcaccatgttggccgggctggtcttgaactcctgaccaaaggtaatccgcccaccttggcctcgcaaagtcctaggattacaggcatgagccaccgcgtccggcctttttagcgtcttttctttgccttctaagtagttgtacagatctagaagtagtgctagctacattacttgtggaatataaggttaagaaattcccaggaaaagtttaaataatttcaaggcaattatttcagtaactttaaagaaataattagaatttttagaattcaccaataagtgtttatatagtagagatgtagtggggttagggatttgggaatggcaaaaggggataaaacacacagccagaacctcttcagtggtaactgctaaaacagcaataaacaacaaaaccaccagtggtcaaattgtgtagtatgggctttaggtgctaaagaagttcagaaggagagaaattttagtgtagtctttgataatcagagaagtttgctggtgaagctgggtcttgatctaggtctgaagggatgaacagaatttggataggcagaggtaataactgttccttagtgtttaataccgctgatctgcagtgggaatctgcaaattctttcacattataaggatgtaaaatatttccaaataactagcaaacctaagaacttgactgtgaatgcctaagatgattcagcaataaaacttctagacataaataaaacccatctcaaagccctgactcagcaataaaacttcgcagacataaccccataggaagaagaaataccaccactgaggtccacagttccagttgggaaccagcattgccctgagtttgtgcatcagatcttcaaaagataaggggtcaacagattgtgattatgcaaaagaggtgttccaattctactgattgtgattatgcaaaagaggtgttccaattctacttgggcacacaagtaagtaagttaacaagagaacctgaaagttagctaaattggaaagctggctgaaatgctaaataaaacatactcagtaagaaacggcgtgttcactcagcccggaggaagtgcagcagaatggagaatgttttctaatacagctctactcattataatctcagctcagagctcctcagtgataggtacagaaggcatattggaaacttcccacatgtctatttcctactaagtctatcatcaaaaactgcaaaatttaaaaatcacagtgaatgttgactggttttcttcagataaaatgatgatgaaggtattaacattctgtgctatagatgccatactgaatgtgtatatataattaatattatgtatacatatatgtatacatatgtacatatgcatacacatatatatatagtcttagtccatgggctgttacaacaaaaacatcattgggtggcttaaacagcaaacatttatttctcacaattctggaggctgaggcttcgaagatcaaggtgctagaagatttggtgactggtgagggccttcttgctgattcatggatactgtcttctcactgtgttctcacgtggtggaaaggagtgagaaagctctctagaatctcttttataagggcacaaatcctattcatgagggctccaccctcacgacctaatcaccgccaaaaggcaccacctactaatatcatcacattgtgggctaagatttcaacacgtggatttgggggagacatattcactcaataaccctgtaaattgaaatttatagttgttttaagagtctgctcacctgcctgtgtaccccagtatcctcttctcattgaagtccagtctcatccttcctaacaactcaaaatctagactcatggacagcattcttgtcacattattccccactactccatgcccatgttatgttagactcgtggttttgtaaacaaacacattttgaactctctttattttcaccttcacggatatccagcaggtcactctaaactctgccttaccagtttattctgatcttatcaggcacgtgaagttgtggtaaaatgtgttctgtcctcacctctgtcatcattgctgctactcatggaactcagaccaggaaagccagagctagtacaaacacctccaaagaagtagcaaatgactggttgtgggcaagagtaacatgaagactgtaattctgagacactcacccattccctgccagggaataatataattgtttacctgtgttatagacacccagaatctaagagaggcacaagaatccatctagccagatctggcatgagactcatttgctaaaggtccccagggggaatttgtataagaagaggagcccaaaagtgcatggaatagatttaagctgtcccttgaaatgaccttgcctggttaaccaaaatctggattcatttttactgtgtcttttacaacaatcaccttcacagcattagacggaaccattaatgaaagcaggagctcttctagtcagtacacataaaaagaagtcgtttaaacccagtattacgtagatattaacactaaaattgcaaaaaacagtttttaagagaaagaagaagttaagaagtatcaaaatatcagcacttatttctataactaatgtatatatagaagacatttaaatggaaattatctgtgaactaaaatgagaagttagaaatagtacaataacagaaatggttattgaaatcatctgaaatttccttcccttctacagtatcaaataatgatatgacagtctaagttgctcacagaataagatagcattaggaagattttagaagacatttttggagtttcacgaaaggaggtccctgaagaatagaagatggtttagataatgctattatttaatcaaaaatgtcaaataccagcaatcacaccacctgcttttgaaagtaaaggaagctagggactaaaaggggtggtttaaaaagagacagaggaagaataaatgacaaaaagagaaaaaaataattatagatagtctaaaggatatggatataggttgtatttaagcagtgtttttttgtctcagaagtttatatgtgaactaaaatgtattaaaggataaaaaagcaatatgtacaactttttgtatgtcagtcatgcctctataaagcagttttcttaaaaagataaagaagaaaactctaggaattagcaccttttttaaaggatgagaaaagagagtccagttacaataactgttaaggttcttaaattcttttacacctcttacccccatatttctggttttcactgtatgatagtttgataatacagcccaaatttaccttttagctgtagctcttcttctttgttagggcttgattcttaaggagattgctcaggtgttgagaacaagtagtagagacacctaagtatacccagtattaatcccagaagaaataccatgttagtcactttcacttcatgcagtagctaatctttttttaaaattgtgttagcgtaaagtgttggtgaacccactcatttttacatgggattatcccaatttacataacctttttgtaacaccacattttcaagtgttggaaaataaaaacagattaacttaatattgtgactaatcgagagttaaccaaaaataattgtatttcaaacctatgactgaaaatgtttcttaaacattagtcagcttccctgccttagggattgttgactcacctccagttgtagggtgaaggatagctcagccattgagactgctgccagcctcgtcacccagggctgtaggtcaaggaggtgccagaccagggcctgaaactactctgaaccctgcccccacgttcactggttttcagcactaagatttgcttgaagtgaagaaattgtctagatgcgtatggacagtttgacattgtctgagtaagggaaaatatttttattttaatacttgtcttttaggaaaactatcatttgtcaacagggatctgtatgttttaataaagcagaggaagggtggtttgcatgtagtcacttagctaaaatttcatgtcatttaaattttctgatcatgagtaacccagaaaaattaaatatacttaagataaaataataaaatcctttcatatatataaataagcaaccaggatagttttcattctatctatctagctagctatttatttattatgttttaatttctttttttacagacaggtttttgctctgtcacccaggatagagtgcagtggtgcagtcataagctcactgcagcctcaaactctgggctcaagtgatcctctcaccttggactcccaaagtgttgggattacaggcatgaatcactgtactcagcctgggaagcgtgggatagttttcgttttcaaaagtcagttaagattatctttagcagaaatactccatcagtgctgacttttccaatctgacatatgtagtagcgtaagaacatgttttaaattttaaaaactaataagaaaataagtaaggcaagttcttcatataacaacaatgtatagaggaaagagcaatatgttaagaggagaagaaataaatttatttctatagaaacaaagacccagtgggatcaaaagaatttagaatttttaacacaaggaaaatacccatgcatggtgaggtagtagatggcttattctcttcctattcctaagatatcagtgttactttagcccaccgtaaaggaatatgaataatttccatgaatcaacgtaatgtatgcatctcaaaaagatttttaatttttaaaagattattctgtagtctcttacagtattttcttgtccaagccttagctgaaggattgcagtgtttctaatgatagtgaagtggctctaatgaggtggtctcctgatttaaattattgtatcaacatcttcatgtaacccagtaacaaaatatatgtacatacacatatatacacaaaacatgtatgtatatatgtatgtagtagatcaaaaattagaattctatttttcttaaattttactttaagttctgggacacaggtatagaatgtacaggtttattacatagatatacctgtgccatggtggtttgctgcacctattgacccatctctaagttccctcccttcgcgcccaacccctcacaacaggccctggtgtgtgttgttccccactttgtgtccatgtgttctcactgttcaactcccacttatgggtgggaacatgtgtcgtttggttttctgttcctgtgttagtttgctgaggatgatggcttccacctccatccatgtccctgcaaaggacatgatctcgtttttatggctgtgtagtattccatggtgtatatgtaccacattttctttatccggtctatcattaataggcatttgggttggttccatgactttgctgttgtaaatagtgccacaataaacatacatgtgcatgtgtctttatagtagaatgatatatattactttgggtatatacccagtaatgggattgttgggtcaaatggcatatctggttctagatccttgaggaatcgcctactgtcttccacaatggttgaactaatgtacattcccaccaacagtgtaaaagcgttcctgtttctccacagcctcaccagcatctattgtttcttgactttttaacaatcaccattctgactggtgtgaggtggtatctcattgtggttttgatttgcatttctttaatgatcagtgatgttgagcttttttcacatatttgttggctgtgcaaatgtcttcttttgagaagtgtttgttcatacactttgccacttttttatggggttgtttttttcttgtaaatttgcttaagttccttgtaaaatctggatattagacctttgtcagatgggtagattgcaaaacatttctcccattctgtaggttgactgttcaccctgatgatagtttcttttgctgtgcagaagctctttagtttaataagatcccatttgtcaattttggcttttgttacaattgcttttgacatttctgtcatgaagttttttcccatgcctatgacctgaatgttattgcctaggttttctagggtttttttaatggattggggttttacatttaactttttaatcattcttgaattaatttttgtataaggtgtaaggaaggggtcctgtttcagttttctgcatatggctaaccagtttttccagcaccatttattgaataggagagcctttccccattgcctgtttttgtcaggtttgtggcagatcagatggttgtagatgtgtggcgttatttctgaggtctctgttctgttctattggtctatatgtctattttggtaccagtaccatgctgttttgattactgtagccttgtaagatagtttgaagtcaggtagtctgatgcctccagcgttgttctttttgcttaggattgtcttggctctacagggtcttctttgattccatgtgaaatctaaagtagttttttctaattctgtgaaaatgtcaatggtagtttgatggaatagcgttggatctataaattactttgggcagtatggccattttcacgatattgattcttcctatccatgaacatggaatgtttttccatttgtttatgtcctctcttatttccttgagcagtggtttgtacttccccttgaagagatccctcacatcccttgttagctgtattcctaggtgtttgattctctttgtagcaattgtgaatgggagtacattcatgatttggccccctgcttgtctgttgttggtgtaaaggaatgcttgtgatttttgcacatttattttgtatgctgagactttgctgaagttgcttatcagtttaagacgttttggggctgagatgatggggctttctaaatataaaatcatgtcctctgcaaacagagacaattttacttcctctcttcctatttgaataccctttatttctttctcttgcctgattgccctggccagaacttccaatactatgttgcataagaatggtgagagagggcaaaatataaagaccaatgacactatgaagaaactgaatcaactagtgtgcaaaataaccagatagcatcaggatgacaggatcaggttcacacataacaatactaaccttaaatgtaaatgggctaaatgccccaattaaaagacacagactggtaaattggataaagagtcaagaaccatcagcgtgctgtattcaggagacccatctcatgtgcaaagacacacataggctcaaaataaagtcatgcaggaaaatttaccaagcacatggaaagaaagaaaaaaaaaagcaggggttgcaatcctagtatctgacgaaacagactttaaaccaacaatgatcaaaaaagacaaagaagggcattacataacggtagagggaacaattcaacaagaagagctaactattctaagtatacacgcacccaatacaggagcagccagattcataaaacaagctctcagaaacctataaagagacttagactcccacacaataatagtaggagattttaacacactttcaatattagacggatcaatgagacagaaaattagcaaggatattcaggacctgaattcagctctggatcatgtggacctaatagacatctacagaactctccaccccaaatcaacagaatatacattcttctcagtgccacatggcacttattctaaaattgaccacataattggaagtaaaacactcttcagaaaatgcaaaagaactaaaatcataacagtctctcagaccatagtgcaatcaaattagaactcaggattaagaaatccactcaaaactgcacaactacatggaaactaaacaacctgctcctgaatgactgctgggtaaataatgaaattaaggcagaaatcaagaagttctttgaaaccaatgagaacaaagagacatcataccagaatctctgagacacagctaaagtggtgttaacagagaaattcatagcactaaatgcccacatcagaaagctagaaagacctcaaatcggacaccctaatatcacaattaaaagagctagagaggcaagagcaaactaatccaaaagctagcaaaagacaagaaataactaagatcagagcagaattgaaggagatagagacacaaaaaaaaccctccaaaaaatcaatgaatctaggtgctggttttttgaaaaaattaacaaaatagatagaccataactaaaccaataaacaagaaaagagagaagaatctaatagacacaataaaaatgataaagggaatatcaccactgacctcacagacatacaaactaccatcagagaatactataaacacctctatgcaaataaactagaaaatctagaagaaatggataaattcctggacacatacaccttcccaagactaaaccaggaagaagttgaatccctgaatagaccaataacaagttctgaaattgaggcagtaattaatagcctaccaaccaaaaaaaagtctaggaccagaaggattcacagccaaattctaccagaggtacaaagagggtttcagaagataccattccttctgaaactattccaaacaatcgaaaaggagggactcttccctaactcattttatgaagccagcatcatcctgataccaaagtcagacagagacacaacaaaaaaagaaaaatttaggccaatatcactgatgaacatcgatgcaaaaatccttaataaaatactggcacaccaaatccagcagcacatcagaaaaggtatccaccacgatcaagtcagcttcatccctgggatgcaagctggttcaacatacacaaatcaataaatataatccatcacataaacagaactaaagacaaaaaccacatgattatctcaatagatgcagaaaaggcctttgataaaattcaacatcccttcatgttaaaagctctcaggtattgatggaacatatctcaaaatcatgagagctatttatgacaaatccacagccaatatcatattgaatgggcaaaacctggaagcattccctttgaaaactggtagaattctatttcattcaaaaatgattaataatgtttgaacatttgctaagaatactgtgattactgttgctttcagtaacttcctttgaattttcttcataataccaaaagattaaattttaaaaaaccattagaagagaacatgggagaatcttgctatgatctaagagtagggaagtcctttccaaacaccatataaacattaagatgatctttagcttcaactatatataaaagcaaaagtttgaagcttaataaataagcatgaaatgacaactagcaaataagagaaatatttgcaatacagtatattactgttaaatgcttctttatccaaaccttttcacagagatacaaacttgtaaatgtgtttgacaatattttattgacttgtcaagagaatcagtgcacagtgtaggtgttgggaatcgttttagtgctgttttcatgctatttgttaaaaaacctaaattttcatgttatgatttagcataatctctgagctcaaactgtgctctcaaaaccttagggacaggaagtagtatggttcaggaagaaccaaagtaatttcaaagccaaactagtcagtacttgaaaaagtctaatttttgtggtggtttccaatggagaaaatgaaaataatccctcttcagaatttggctctatggactgtttgggagactgaattgctcttttcccatttgttaaaccaggaaatttctaaggctccttccagctctccaattctctagtgctatgaatatcctcattattatcattacatctcattttgcttaaagaatgctaaatcagtagtctcgtatcttacatctatctttgtgagaaagagtaaagaaaactgagtttggtttctttatgattaatgcatttgtcaaatttgttccaagtagcaaattaatttattgtgttttttcatgaatgcaaattaaagctgtgcaaactattgtggtaaaacttagcagtccttttttataaattaaagctaactgatttaatgttaatgaaaggaactatattcaaacacagattttaataacttgggtggaaagaaaatcttagacttcataagcttttccttacataaaattcatgtaatttgaacagaaagtcattaaaatgtaattgtctatagtgaagcttgtattaattaccttgtatgaaaatctgaaaagttcctgaataaatgtctgtttctatgcattccctgaagagaagaattgtctattgattagttaattatctcaaaccaagggtcccaggttcagtttttggtgatcactttcttatctttttcctgtttgaatattctgatcaaaaccagaagtaaaacagattttttttaaatagagaagtattttgcttctgttcatattgataatacaaagagtaccagtatacatatgataaaatatttttcaacttcttggttcataggacttaatcagtgtttcatgtatctgtgtttgtgggtgtgaaaagcacctttattactgggaataagattttaagaatgattttagaaacatgtcctttaaatttgattctctcatacttttaagattatttaaattcacttcaatgtgattgtccaaaacaaagttattttcaaactcactgaatccttatgttcttctttagtgttcactattcacaaagcccattttgaatactgatcctgaaaaacatgagagaatcaaaatctgtgttttcttttgatttttgcatcataattgcatttttactcatttcaacaaggggaaatttcaactttttatattgactaaataaacaaagtgtaggggctaatttatgtttttaaaaaggaaaaatttatagatgctatgtttgattacacttatttcttaactggtatttaggaatttgtgtaataataaacacttctcatttttaacatcaaaatttgcaaggttcatcaaattctgaaggtaatgcctgattggagttaatgttcacttaattctgggtctaatcatttcagctgaaaaagagaaaactaaagcataaatcctttgactcatcctatcttatatttatgtcatattaaaagtcataaaaatggacaaaacaataaaatttaaactgaaacatatccaaaatgtttttggcttatctacctacaaaccagagacatgccaggtatgaaggaacccaaggctggagtaggtcagagggtccaatgagtttatccatcctccagacatggtcactttcagattgtactttaagaaaaaataacttcacggaggaccattataatttttgtgatgaacatgtgtaatatttttgcacccactttttagtttttatcttggctgccttaacatcttctttcaaaatgtcagcagtgattaggctacattatgggataattagtatgaacttttatctcaaagctaattttgactaatactagaacaaaacatatgtcaatatgttaaagatgggaagttgaacagattgctttcctatataaacatgtttttttctaagttcaccttactttttaaatactaatccaatctaaatgtttgaggaaggttaagcaacctgtgaaagaagcaccatttgaaatttgatggtgcagttcctaaaatctttccaaagaatgtggtatagatgcttacatattaaaatattgaccttctaggaagtttaggaaatatttcctctgaacttgaactctggggctgtagctatggttgataagctacacccaattcacactttaatgccggtgctttgtattttaacattatcttaatgtgacattgtatgccttgtttatttcttctaagcaggccttttcccaaattacttaaaattaccaaacaatgtgtttttaaccacagtcattctagagatttatttggtttttttccttccccagaagttgcttctgtcatgtttgattgcacatctgaatacagaccatgctcagagttgtagtgtaaacctcttcaggtcggatcataagcctcagaacgtgtcatacatcccataaacttcagaactagccatacacaagcttcagaactagtcatacatcccatgaagggcatcataactgatactgatctgaacagttcagtccaacagccaggcaattcagccacctacaattcaactattggttttatttgaatgaaaatcaaatttggggtataattggcttagctaaaatattcaactgggtcaattttggtcacatgagtgattctgcacaaagatatagccacattttatctcaggcatctcactcaacatttttaaagataacattttttaaaatctcgtacaaagactgcagtaaatatacaactaagagtcatactggtggatggtaaacatctgggcatgagcattatgagttaatgtgtttttgtacactgactttccatctttgcagattattctaactctctagaaataatgggtagccctttggcactgaggctcactggctcagggtcagtatttttacttctccatcttctctcagttagcacttgaacaaacaaagaaaaacaactggtctgctatttccaactcctgaaagtgaaatagggaaatagggacaaaatataattaattaaaatatgcagttattcatacaggatttgcttttgttctgataattaggatcccaatttgtcaaatgctttaaaaacatagtcttacagccttttactaagggagcgggaaggggtgaatatccaggttgattataagccatatatttgtcttttcaagatttgcttttacattgctttagggaaaatgataaatatatttgcaaataaaaattgtaatctgtatttctccaattttagtaatcccaaattactaaactaagtaatttaatttaggatttcggattaagagactacgaaactaaatctgattaaattatactttttgaaacctgatagtaccgtacttctgctgcactgcactttcttagatttaatgcctctaaagtataatgatattataagtttcttttctttatttaaaaataaaatgattactctaattatgggaactcatgtaccattgggctgaaagtcagagacagctggatggtgaactggccccttgcccagacctcagaggaagattaatttgaaaactctttacagaacacagcccagagcctactgctcagaagatcttgctttaatcagccattgatcatcagagattccctttattgacctgaaagcaagtttttttcatcttcatgccagctaaggcacttactgaaagtaagtagacagcatccaaagtgaatatgcctaacgaagaaaacaaagttttccatctctccccgcaaatgacattctgtaatgacatgtgctaatagtttctatctccatccatcccttaacccatcacgttgccatcctgtgaggaacctgtggttaacaaggggccccttctgcagatacacacgtcaaatgatctaggaaacatgtcggcagggattgtggaaccggtctatgagaattctctttgtatctgaaaaataccatggagtggatgcagggcagtgtttacccccctggatataacatcagaaaattccagatcactctgaagtctgttctctctctgatttacctgcctgtggagtttgaaaggtccccactagtgctgactctttctgacacttctcaatctatagtagcttggaggccactttgattgctcccaaaggcaaaatggggcaccatgatacttttttcactcaaaagggccagcatttatgggatatactcagtcagattctcaaaattgcttcagagaatcctctgttagattaaaggaggtcatttaatcaaacgactttccaaaagtccctgttttgaattactggagagaatgtgtactatcagggtcctggatcacttagcaaacatcagaggaaaggtttcaagtctgttttgagaaatgtactgtccaactctactgctttttccttcagcaaaggagatttatcaaggataaatttggttacagacatacctgttttcgttaaaatgcctttggccattacattatctgtaataactttcagtaaggtctaagcaatttagaataatattaatagaaaaaaatcatgattctctacaccattttcccttccattttatctaaatggctagaagtgagtgtttgcataattttttctagtgtttttctcccattttgccatgatctagttttatatggaagtcataaatttgttctaccaatggagtttgttaaaacaatattttgactttgcagagatcattgtatattttctatttattttaatgccaaacttttaaaaatattgactgctaggaacttaagagagcagaaatatcactttgaaaaatacaaaaattcatttttttctagttgatagcttgtcttttaatattcattgtggtatatctgtgctatgtaatattataagccttgtatctgtctcctatactttcctataccctcacataaatactatggaaaattattatgtgcatcactacccaacactttagccttgacttaaaacggtaagataatttcttgtaaacaggtatctgagctttaaaaaacaaacaaaaacacattcctgttagctctaactttgctcagatcccttgagagagatcagaactcatatgaaaggtgaacagattcttccctttggcaagcaattccttcaggaactgagttatgcttatggtgggacttccaattagaaaagtaaattttaaaacaaacaaacaaccaggctgttcagagattgctagacacaagatcaagtcccagccaggtgtttgacattgcccagtctctttactcttgtaatgtgaaacttagagtcagcttcttcactagtgtttttggcatcatagaaaccacacacctaaccataaatacaaaccatagctggtactaccagtgcagttctcactcttgtagaagcatgtccagtccttctcaagtcatcaactaacaagaccaaatgcacatttctagcaagggagtccttgagcccatccagtcccctgacttcacagcgatgctgtggcagcccactctgctgccgcccacaagcacacatggaggggaagccagcagggatgtccaggtctttgcccatggcctgatgaagaaaggcagctgcagtcatgaattcatagaaccagaagtgacattagcagccacctactccaactgctttccaagagaaatttctcaagagacatgctgaatttcaagtcaagaacaacttggaagccacaaactcagctggcttacagttgccatggaattttgggacttttgctgcaaacagaaacaggatccacaggttataactagctactgaccagtgttacagagcctgtggacaatctcattcctggtttctcctacctctcttcattttcctgtgttccccaccatcagccctcctctgggtcttctccctttcttactctgttctttttaccagggaagcctcatccactctaatggcagagtgctagttttccaccgaagatttgcacacacaccccagccccagctgagtagtggagaggtgttgcccggcagctgtacttgctaatggcatgggaacaaagtgttttagagtggaggtaccttttccacctgctcatcttctgcctaccatctagatgccaatgctcaaggcaatggtggatgccctggattgaagatgacagaagtgtcatcggtctgaggccctaaataatgccatagaccagagctaagctgtgttcctctccatccccttccagacagcctgccaccaatcaggaacactttacatagtgagaaacaaacttcgattttgttaaacccttgagatttcaggctttaactattgcaacagctaacattccccacctatataattataaaatcttcagattccatctatgctaattactcccaattctgcatctctggcatagactttattcctgagtttcacaactgcatatccaagtagacaggtccactataatgacctgcaggtcaccaaattcactatgtctgaagccagacaaatgatccactgctttcccacacaccctggccattcctgttccatcatatgcttgtgaataccaattgtatgcacccaggtactcaagagtgccctattttatctcccatactactctctcctaaatatctatcctgtccatcccgtttatctctccttattgccacattcttatctggtttcaataatagtagcctcaccccctactccagtctgtcctccatgctacactagaggtgtctctttgaaataaaaatctgattatgcctctctactccttaaaatccttccatggctctttctgccttgcagattaaaaatcaaagtcctagtgtaacacctaaggccactttatggaccctttgctgctgacctcctgtattctctcttaccattctcccattgttccatttacaatgtatgtcctgaagtttctcaaatatcccttccctccatgctgctgattttgtagtttccagtatccagaacacaccacacccctcctgccagtgtacttcttcctcttcatcattcaaatctcagttcagagatcatctctcttgggaatcttcaacctccacattccccttagagatcacgcctctatctttcttttcctcatggcttctgcctgcttcatagagttggcatctgcacaattgttagcaaatctaggagctcttgaatctttgccctagtttgatgttctttgagaacagccagctacaacactgcctgcaacatgccctcaatacatgtttctcaatttaacctgtattgtcatccactcctaactgcatatcctgataaaatgatgcatatgtagagctgagggtaatgcctggcttattgtaagcattcagttgatgttaacagaatcaatcatagtttttttgtattattatcattattgcttttattactatcagcaattactcaatatttttgaccatagctgatttcacatctctactaagttttgtttttctttttcttctggttcacaatcatatgggagacatttgcaccaaagtagcggcttccttcttatggctgcaaatgagcggagtgaaggtcaagggatctggagtcgtgggttcaggtgccaccactgtcaccagctgtgtgggcataaactagtcatttaaccgctccgtgcctcattttggccatctgtgacatcaggacaaaaatagcttcctgacccacttcaacagaatagttttgagaaacaacctagataatgaatgtaaaagcattttgtaactctgaaaatgataaaagtcaattattagtagtatttccaatgacataggcaatattagtataaacaatgctttctctgttgaatattgtcattcctctattttgccattatcactttcggttatttttgcatttcctagtgagtggacaacacatgtaagtcatgtgtttcctcatgggcaaattctcaatttcatcatcccaggcatcacataaattctgctttgaggactgcacacagaatcccctcactgatgatgttgctctaaattgacattgtctgtttgtctttgaatctatctttctaataattgtttccttacacggcatttcaacccatggtagacatactgatttttgcatgaatgaatgcttttgcagatacaggcaaaatctttgcgtgcccagagttttgtctactatttcctatttgacttcaagcttctcacttgatgttaatgaggatgacggtgatgatgatgaagactgacatttttgaactcttatataccaggcgttttttaagccctttacatttaatcctcacgatgacttggtcaaaagaattcgtgtgctagatccactaaaacgtaaactccatgaggtacagaatctttcatatatcatcagttttgttcactgctaaatccttggggactaaagcagtgcctggcatatagtaggcgctcaagaaacacttgttgagtgaagttatttgcttctcaaatgattttttaattatcaaggctttggagttttctgagcatctatagtttgacggtgatttcttattggtagtaacagattattattgaaattattaactaaatttatataatacattatagtttataaaacactttcacatacataacctcacttaaggcagtcagtgacatttttccactagaaatactgaaatacaatgtctctaccaaatgaaaaataaaatacagccattattacaatactaccattgttccatttcttcaatgagcagtaagcatttaaattaagaatgactagggtttctaataaggattgtcaagtatcagaattgttgggggtttttttaattgaaagaagaaaatactagaaaatatttctccagttggcttagaaagaaggaatttccatttgagttccaaatttacttaacaatctggaaaggtagctgcaagtctgattctggtaagtgtttgtgtctccgaaatcagtggcaacaaaatattttaaataaaccaagtaaagtttttgagtatgtaattaaaaatagaactgatgagatcacttgccaagaaccgtgaggatttgcattaaaaacaatgatttgagacagtcatgatttattcagcacattctacccaatgagagaacaattcgtatgaaagtcagggagtgctcagctatgttatagaaagtgttgcgtgaggtgtctgtggtgctggagtaggataacattttctataacttgagcagtgtgtctctaaatgaaattgtaaaatattatgatatgttaaaggccaggcaaaattttataaccagaatacaatgatcatttgcactgaaacattggcatctgtagttgtcactggtttttagtaggtgaggggaaatatctcttcaaatgatcagacaagtatgactagtgcatttgtcattccagtgtcttcggcacttgaagtttttccatttttgttcaacaatgtaacctttggagttttgcctaataatgacttcacttgtgctggccttccaacagataaattaaaatggaaatgcatattttctaattatgcatcgagccttagttgcatattggcgagggtggccacaccgaatgttaaattaagtctgcacaatagttagagtctatgtaacatcaaagtttcccaaagtcactttcttaatcatgtgaaggatagccaagactttgatcagtagtatgtagctatatacgatcagaggaaaaacatttaaacatcccagcatggtatttccatttaaatctgattacagtgaaataaaactgtagccattaaaggtttaaaagaactacaaatacagcagtaaaagaagacagatagtaaatgaggtagtaaaacatttcggcagggcaaacagtttacagcactcattcagtcgtcctgaagcagactgtgcaattcactacagacctggcaccgttccctgaactccacttaaacctacaattaacctttcacacctaatgaagctgttttcctggaaaattaaaatatataatggtgcctgcttttacacagacttcagaggagagcatttcaaagtgaatgacttttctgaggcttttgttcaaatgtaaaatggaagtgctatgtttgtatataaagcgggaatgttctttccaaggcaatttcatttgatgtgcagtattttattactgtacttattaattgttctgcataattgtaaaaaacacacatcagtaattttatgattagattgttactgctgaagtctgctattaccatttcacttccattagggaaaactagagttttgctaacaataactaaattcctgatgtttctccttggtggttttcattgcaaatttagtggtttaaaaagacatgtttaccatttaattatttagctgttatttacattgctgtctcttcaggtcatgttttcacatgtttcaagagaaataaaattcttaaatttcaggaggcatatattgtttttttctaaggttgcaggtgaaggtctgattttggtgtatgttctacttatttacaaaatagctgtggggtactcccacattcatttcagcattattcacaatagtcaagatatagaagcagctatgtgtccatcaacggataaagggaaaaatcaataaagagaatgtggtctttataaacaatggaatattatacagccttaaaaagaaggaaattcagtcatttgcaacacatgaatggaactggagcatattatgttaagtgaaataagccaggcacagaaagacaaatactgtatgacttcacttatatgtagaatctaaaaaaggtgatctcagaaattgagagttgaaagctgattaccagaggctaggggaagggggagggatggggaaagggaaggttttgatctaagggtacaaagtttcagttagactggaggaataagttttaatgatctattgcactacatggtgaccacagttaataataatgtattatatatttcaaaacaactaaaagaatagatttttaacattctcaccacaaaaaaagatggtaagttggagaggtgatggatatgttaattagcttgattgactctttccacaatgtatacataggtcaaaacaccacattgtatctcataaatatccacagttatttgtcaattaaaaataagctttaaaaatagctgtggtaactcttggcctccagcccagggaccactgagtcgtgcccattttctgagggaatttcctatggtctcaaaggagcctgtttcctttagggcttgtcctgccctaggtgaaccagagcagccactgggcctgctctctgttagcaaggaccagtttgaaaacaccaagagaccatggaaaattgaacaggaaacagaggatggtatgttccttcctatgcggtttatacttcctatttaaataatctaaatgtcatagtgtctggtgtttaagaactaaaagtacaaaaaggtaaagcttataataactattgaaaccccagcatttttgttgaatctactggtatatttttatgtaaatcctgctagcctgcagcatctgtgcatcatctttacgtggtaaatgaaattcctttggaccatcagtctaaaataatgaattgttcccccagttaattgtattgctttgataacaaggaactatgctaggcctagagaacacaataagtgaatttcatcagatgatttgtgtgacgtcttgaaaaatgatcttctggagtgacctgattttaatggaactctagcggcgtgcagcatgggcccagcatccaactaggaggaagcacttcctcctatggcacaagaagtgcgggatcatccccagaagacctctcaccaggaaaaattctcaggaaagtcatgagaaagtgtgtgccaaaaatggcaacacaaagaacctatttctaggttgcttttcttttattgatacataccttttttaaaacccagaaaagatcgcaaacgacctttatgtctttgttgccagcgtgaaaataaaccaagaccaagcaaatgaaaataagcaaaagctatgtattctgagcttgctatagcaagggagtcagccactttcacttgtgttttggcggagactcaaggacaggcaggaatgggaaatctttatagtgaaaaaagggaagcttcaggtgtgccctgatgagaggccgttagcttgtgggagctgtagacagactaactagaagtggggcatcctatgtggttaggggtacatatttggtttcctctggctggaagtgaggacataaattagggaagctgtttattaatcaagtcctggccatttggggccagtcgtgacagggattacagtttaacttcatgggttattagtagagatagcagtctgacttcttacaagtctgacatagcaggctggcttcctgggctggttattgcagattatagctcggtttcctgagcacgttgccacaagttgtgggtcagaattctatttatacatggtctgggcattatctacatgttcagtatcttaccagaatataactgctacatttaggggacgggggaggtaatacagtctttttaaaaaagctattgacttggcttctcttttcatcagttaagaaaattagattccttacaataacaaagtgtgctgaaaggcaatgacagagattactctctctctctctctctctctctcttctctctctctctcttttagtgagtcttccatacacactatcgaattcaataagataggggctttgtctctttttttcattcttgtatctaggttctcttgtaggttgaaagagaacgtagcaacttctgatgtttttaaggttcaccttatatttaacatgaagaaatgcaaaagtagtaataacttgatatttaaggcacacacacatataaatgcagttattatgattattatcctgttcataattaaactacaaggtttataaagaagaataactcatgatgggccacaagccgtggggtccagtaaaggacctaagccaaatgaaacattgtttggcccatcaaatgggcagataagactttgggcaaatggccctgagtgttctctgtgagtgcaccacggcgaacacttaaatatctctgcctagagaagtgcaagcctttctacatacacattgccatttatgcagatctgaaaatgcagttgattgttacattttaataagaaatgacaaaaagctgtcaaattaaaaataagcatgatttgcaattttatttgtaaattaagaactgaaatatttatgattttcaactgaatgtgtttccaagtttcagaatcattagtaaacccaggacatgttgtcagagacattgcttcagttaggttctggacttcatgaaatacagcgatacagtggcagttttggattagcgtagaatttcctgttttggcaactcaagctgcttactcctctcccgatgctatatcttctgtaatgaaaacatttgcattcacatgtaaatggaaagtattattttttcagagcttctttggactacatcatgcagtagtttaatgaataacatgatttcatatttggatgttgtgatcattgaaattagtgtaagtggtctctgtccacattaaaggagacatgtattatttgtcatatttggctgtctctggattagttggtgccaggaataaaatagcaggaagttgtaaataatgacagaagtatgccagaagatcagtggaaacttacagtcagcttgaacttttagttagcaccaccaaaatctgcaattttaaaaataataacaaggtccttcagctccattaattaaacaaataatgaaataattatttactactgcagaataagtgtttaaaacatctatgttggactcttcagaagttcccacgtgctcttcaaaggtcaagaaaacagcttttatgtaaactttgaacttgtaataactctaaaacattcaggatgatatttaatatcctgaaagagcaaattacttaagagcaacccttaaaaggtaaatctgtaaatttatcagcttagccagagcttattataattttgtaatttctttccttgctaacaccataaatttctccttctccacaaatctcttctgttttcaaatgtatccaaggctcccttttcctttaaataatgcacttacataattccatgcatccacataaattccatctgaccctgctaattctgttatgtagataagcttccttatctcttcccattgctaaacatcttaaacatggaacttatgtctgctggccgtacttcctgtcactccattcgttgtttaactttcaggcttccatcctcagttagataccgaaatgactcaaagatcatcagaatcttcttggaggaagtctaatggcctttgccacaggccttaccctgctggcccatttgccactttttacagactccttgggcttggccctcccttgactcccgcaacactgcactaggctagtttgctttcctcttacagtgctcacatccctttactgtcatttctttctgtccataaatctctgaattcagttcctgccaggaaatatgtgaagcttacccagaattaactgacccacaggaataaaataatgatattctacgtaggataagatctgaaaatgatcttcctctaagagcaacatgtggagaagaggtcagctcaattcaaagtcaagtcttcaagaccttgtagaaaggaaaatgagccaaaagtccttttgtggccttttcttaagcaaggccaatctggcctcatggtttagtatggtgatttgatacatttggttttactcaagagttatatgggactcaacagatatgaaaatgactcatatgtagctatgataagccaaattatctggttgagccatggctcctataaatttaatgaaatctttactatccctgagcatcttaccaagtgttcctgtccatcattggacaaacaatgtaacaaagcagatcaacataattaaacaatatgcttcttaaattacctatgatagctacagctccgcatttgtggtcacattcggtcaataatactcaaggtccttttctagtacttaagacgcttgtcagctaaatgtcaagtggtctttcttccatgtccatttgtacatagcataactctatccatggagtgcttttgtaatttttaaaacagtttatgagaatgaaaagtcaagccatagactgggaaaaaaatatttacaaaacacatatctgataaagaactgatatccaaaatcttcaaagaactcttaaaactcaacagtaagacaacaaacaacccaattaaaaacaggcaaaatatctgaacagacacctcactaaagaaggtatacatgtggcaaagaagtatatcaagaggtgctcagcatcatatgtcattagagaattgcaaatttaaacaactgcaagatactgccacacacctattagaatggctaacacctaaaacactgacaacaacaaatgctggtgaggttgtgaagcaacaagaactctcattcattgctggtggaaatacaaaatggcacagccactgtgaaatacagtttggctttttttttttttaactaaactaaaacataagcttaccatattatccagcaatcaggctcctaggtacttatgaattgaaatgttatgttcacataaaaacctgcacacagatgtttttaacagctttattcacaattaccaaaaattggaagcaaggacaatcaagatgtccttcagtagtgaatgcgtaaacaaactatggcacatccgcacaatggaatataattcagcaataaaaggaaacgagttatcaagccaaaaagaaaaaaagagatggaggtacgttaaatacatatttctaagtgaaaggagaccgtctgaaaggctacgtactgtgtgattccaaccatacaacattctggaaaaggctgaactacagagacattaaagaaagatcagtggttgccagagacttggggaaagggggatagattggtgaagtgcgggggtattttagggcagtgaaactattttgtatgatactgtaatggtggataccctgcattatgcatttgtcaaaaccaatggaactatgcaacagaaaaagtaaaccctaatgtaaattatggacttcagttggtaattttatctcaatattggttcaatttttctgtaaatctaaaactgcttgaaatgtttttaaaaatcttaacatgactagttttgttcctaaaaaaaaaaaaaaaaaatagtaacatttaaaatttctagtacctccacagcaaactcgtgttcagacatggagaggaaggtttagggtcatatgcacaactaaatgtgatcatttgtcaaacactgatttgattgttccaagtcagagtcagttaactttcttagatctttcttcttcttccttggtgaagttcacatgcccaagtcaagaaacattttaggtaaagggcaaactacttgaaaacttccattaacagccaaacgtgtgatgactaaatgaaaagcaataaaaagcagggcccttcaccaccactgttgccatcccagaaatgtctaagcaagcatttaaatgcttttctctttccttccaggccttgcaattgccagtgccctaatagatatttcacaacagaaagcttcagatagtaaagataagacttctggagtccggaatcgaaaacacctttcaacacgtcaaggaacttgtgtctgagaaatggaaaccgctcctgtatattctgtactgttttacttcgggcttctgttaaagctgttctatggccttggattttatggaggcagatctctgtatcatccagagcctgagtacagtttccttccaaatggacaatgacccaggtggccaaagaatgttcatgagttttataaaagtattgatggtcacaggtgataaagtcagtttttaccactatcttaggcttattatagctaacattaaattactctggaaaaagatgtatattgtttcttaatgaagatgaaaaatatgtaattcatataaatcaactgtttatatcccaagacttgaaagaaagacattttttaatgcctgaatgatgagaattgtacagtttttgcctcataagcaaacttgaatcacctgtgtatgaacagggaatgaacacattgcaatggctttaaatgctcttttatctcgttgtaaaggtaaggcaagattttgatgtagtaggatgtaggtaatgtatttaaatatttcatatgaccatatcgtgtccaaactcagtctgagaatgtgacagctttccgcctaactagaatgcagaccagaatgagttcaactcattctgtgcaacttcacagggggtttattagaatgctcagtgtagaggacattcctgtcatccatgccaactacctaactcgttatcagagctgatagagcatggaaaagtctgtccagcgatcagttgttcccctccttccaaaaacagcctccaataccacaacctgaaaagagccgaaatggttattttacagcatacaagcttctgctccagtatgataatttttaattgcctaagaatcattggatcagacctaaatgatccatctgcatttttataagaatggatctttctttgcccttcctctcctagctgctagattttaactaccttttacaaatgttacaaaatgtattttagaggcgacatctctcaagatgacctgagttccttcctgccaactgttccacctagaatacaagtagagaagagcactggctggcaagcatcaacaggagtcttcttcccaacacgagcgcatccatgtcctgagaaaaagtctgtggtttagaaaatatgtccatggttgcccacagtcagcacactcttagtgactcaaaattctgaattatggcagaaaggaaaaataaaacatacttcacattagaacacagaatcatttacatcctaatactgaccacagttcactaaagctcagtagcattaacagatatagtttggaattgcagtttcctcacttcagggtgacaagatatgtataacagtgacagaaatctccaaagctgctgtatatgatatagctttgttaaatatgaaggtcctttaaatacaattgatgtttagtactatatatgtacttttcacattctttggatttctggaaggttatgacactttactgtttacagctaatgcatagttacttgcatgccatggttgtacagtagcagactatgaccctattgtgatattaagtgtttatttcataatgccatttatacatagctgaatttgatgaggattgaatgtcatatataagaggaatgatcatacaatatgtagttgcatcttatataagatttctaggttgcatctaaccatgactatgtcattattttgataattaggcatttatgaattatagtatatattcctcatgttggcatgataattttgctattttccatgcattaaaaataagacaaattcttagagtaattttagtaattttatctataatctgtggggtttttttggagggggaggccactggttgtttctacttccctgtgatattttctctctcattaaaggaatgagctaagtttgtaaatatctcctaaaaacaatcaagtaattttattagcttcttttggaccctctaaatattgacttctctcatgaaaaaataaattgatgaaactaatgattacaaagatataatcattttttaaaaagtgattgcccaatgtatttctctaacaattgtcacaagagaaagcataacaataaaaatacaaaaacatacagatttagatgtaaaatctatataagctatatttttagggaggctaagcagatagtattactgtggaagaattatcaagttttattcacctcaaatcccactgggttcttaaaacttgaaaattcaaattgtagagaattatgagacacaatgtgatgtttagttaaagtcatgctatacctttctgggccacatattgctaactctgtggctaattatgcaattaattctcaacgtatcaaagcttttcactggcagtaaattctttgccctcaggtgaagtggattgaaaagacatcaaggatcaaggataatcactttgaatctgttggtttttccccctacattccagacactttaaatttggatgctttcattttttttaaatcaaaccacacaaatatgcagatactttcccagaatttcgcagttaaatggctgatcctcttgaaaactaaccttaatggaattctaaacatttcagtttagaatgactttgaaaaattccttagatttttaggatgttttattctgccaagtatgaaaaaaaaatggttaaatacaatggagttttaaaaattaacctggggattctatttgaactagaaaattcctattggaaaagaatttgcacatacttacagattcagctaataaattttaagaggattaggattctcataattctttaaatgaaaatttgttttagtgatacacagagatgccgtatactatagtgttatgttcagtaggaaaacttcaaatagttcgtatttaaaaaggtaattgatccttgctgtacttcccaacatctcatcttcttttagctgcagtaagatagaggtgactgtatggctacagttcatggtataaggtcatttagggtgcacactggcacacaggctggaaaacgggcactggacccagctttcaggtgtgtggtgctgggtaagtttcacctttgaagcctcagccttccatctgtaaagggcggtaatggtgcccacctttcgaggcattgcgaggctagatggtaacacacagaaagctcccacagtgggaccttgatgcagcgtagctggtattaacaaccgtggggacaccaggccactctttttctaccagttgttttatgaatccacctattaattttcatccatcttttggtcgtaggtaaaggtcaatcaggtttttcaaaaagactccctgaataacttaagttcctgtatttctaagatatagggatttctacaaaacgactttgacatttagtcaataaagacttaaactcttcttaaatctatagttttaggagagtttttcttaaaattactgactgatgacattgagacaagagcatcaatgatcacctttcacgtacaaactaggcaagacagggtcagtgcttacattttgtggttatacatgatacatcttttctcagtgaacataaaactatgatttgaaaggtgtcttatatttaaaaaagattgtaaaatgaaaactgaccaaatgaactaattctacccacctatggtctttttaaatgtcgagtttcaaaacccatttgccgtatactagagtgagcttggaaacttacctgattacaggaattgcttgggttcaggcagattcccactttcacctctagagatttagattcagaaacactggggtaggccctggagagcagtactcttaacaagctcctcagtgcttcttaccattaggcaaattagggaaacactgcattgggtcaaagtgctgcctttaatcgaccattagagggagttctctaaataacaaagttattactctaattcaaaatgctttaaagaattttccaaggaatacaagccatctggttggtgttagttatagcagtgatttcattagagtgtacatttaacattttagttttatcaaaattttttgaaattaagaattagaaccagagctcctatcagtatatatgtacacaggtgtgcatgccagtgttcaaaagattgtgtaaaagttcaagcccgttttagaaagccaacattttatgttataatatgctgttaatcaggactttattaaataaaaacattggctcttccaa
